United States Patent 12,435,323 (ENZYMES WITH RUVC DOMAINS) - sequence listing, part 3

SEQ ID NO: 7906 - protein, 1390 aa, unidentified
  REGION 1..1390: note = Description of Unknown:uncultivated organism sequence
MKKILGLDLDTTSIGWALVNEKENDNEQSAIIKLGVRVNPLSVDEQSNFEKGKAITTNADRTLKRSSRRNLQRFKLRRENLLTLLKEHGFITNETILCEQGNRTTFETRRLRARAVTEEITLEELARVLLMINKKRGYKSSRKADSGEDGKLIDGMTVARQLYDEHLTPGQYVFNLLRKGKKYLPDFYPSDLTAELKAVWRTQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQLQLLEQNPNTSLKNQVFYRQDYLDEFERIWETQASYHSELTTELKHEVRDIVIFYQRQLKSQKGLVGYCELENDTKEVVVDGKKKTVTIGLRVCPKSSPLFQCFKIWQTINNVQVSGNIIPEKQLDLFGTVAAYKYGSRCLTEEEKQTLYKELSLKERMKATEILKLLFKNAKGLSLNFHEVDGNRTMAAFVKACQTIISMSGHNEYDFAKLSHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSVACEYAGYRHSRRSLTKEELDKKPLVDSLPLLPRNSLRNPVVEKILNQMINVVNGVSAQYGKPDEIRIEMARELKKSAKEREQMTADIARATAQQEEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYDEEGAKEYEKRIGSLYSDGAISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTRHSFIQYLNNLNARSNKAGSIYAIEQTCLYRDGHGKLRFVPPMPLDVFRAEARRQLQNILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVTYETIFTQRKPIDKDLKVDKVIDEHVQKILQARLNEFGGDAKKAFSNLDENPIWLNRERGIQIKRVTIRGVSNAVALHDKHDVQGKTMCDSEGRRMPSDYVSTSSNHHVAIFRDADGNLQEHVVSYFEATARAIQHLPIVDRDYKKAEGWQFLFTMKRNEYFVFPNEKTGFNPKEIDLLDSKNYAMISANLFRVQKLATKDYFFRHHLETSVKEEKLLFDITWKRITSLNKLQGIVKVRVNNIGQIVAIGEY

SEQ ID NO: 7907 - protein, 1385 aa, unidentified
  REGION 1..1385: note = Description of Unknown:uncultivated organism sequence
MGTTSIGWALVNEGENDNEKSSIVKLGVRVNPLSSDEKNEFETGKALTTNAERTNKHGMRINLQRYKQRRANLVRCLKENGIIDDETLLFEHGNSSTFQTYRARAKAVDEEISLADFSRVLLMINKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNASLRNITFYRQDYIDEFNAIWQCQSKYHKELTPALKDEIEKHIIFYQRDLKSCKSLVNHCEFEQSEKEIVVDGKKRKITIGLRACPKSSPLFQTFRTWQKLNDIMVSPSDGKHKSSAMNSVPGLFNDLKTWKPERFLKQEEKEKLFEELSVKGKLTKNEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGMGYSAACEEAGYKHSPRSLTKEELKAKLYAGKMDVVKRNSLRNPVVEKILNQMVNVVNVIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGLNKKEQLTPRGKLHNETVYGKIARYQTEMKRVGSSFTEDVVLSVADKRIREALYERLAEHDFNTKEAFTGCNSLTKKPLWLDKEHSRCVPEKVKTVILEPICTIRKPVDKDLNIDKVVDVRVKEILKQRLKEYGGVAAKAFSNLEENPIWLNREKGIAIKRVKILDSKNNVAIHGKHDIAGRPMLDEDGKPVGNDYVNTSNNHHVAIFTDSEGNLQEHVVSFYEATAMAILGYPVVDRQYNKGLGWKFLFSMKQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7908 - protein, 1394 aa, unidentified
  REGION 1..1394: note = Description of Unknown:uncultivated organism sequence
MKNILGLDLGTNSIGWALVKERENDNEQSSIMRLGVREIYLTADEQSNFEKGKPITTNADRTQKRSMRRNLQRYKLRRDNLINVLKDNGLIKADTLLNENGNRTTFETYRLRAKAVTEEISLEEFARVLLMINKKRGYKSSRKAKSNDESGQLIDGMEVAKKLYDENLTPGQYVASLLRKGKNNIPDFYRSDLVAEFDKIWSFQRQFYPDMLTDSLKEELKGKGDKETWAICSKPFGIVGLKRKTKGWEQKKEDYSWRAESLQHKIDLERLAVVLQKVKGQIKNSSGYLGAISDRSKELFFNRLTVGQYLMAELDKNPNFSLKNQVFYRQDYLDEFERIWDTQAKFHNELTPELKHIIRDIVIFYQRPLKSQKGLISLCELESREIEIERNGKMVKKTIGPRVCPKSSPMYQEFRIWQTINNLQVSGMVVADGQVDLFGEKVGTKFGKRFLEQEEKEILFKELNFKNKMTKREILKLLFENYKELDLNYNEVKGNTTMAALLASCSKIIEMSGHGEYDFSKMSADEITGIVFPIFSGLGFSTDIFSFDSSVEGRAFDKQPSYMLWHLLYSYEGDKSKTGNECLINKISECYGFDKEYAAVIAGISFEPDYGSLSVRAMHKILPYMKDGLGYSDACQYAGYRHSKRSLTKEEIQTKPLKDKIELLPRNSLRNPVVEKILNQMINVVNAVVDVYGKPDEIRVEMARELKKTKAQREETVKAIRKTTAENEKYRKVLEEEFGLKNVSRNDIIRYRLYLELKENGFKTLYSNTYIPREKLFSKEFDIEHIIPQAKLFDDSFSNKTLEARSVNIDKADSTAYDYVKVKYGEDGLEKYKEKINQLCEKKIISKTKLKRLLTTEEDIPDGFINRDLSNTQYIARKACEILEEITRRVVPTTGSVTSRLREDWQLVDMMKELNWDKYDRLGLTEIVEDKDGRRIRHIKDWTKRNDQRHHAMDALTIAFTKPVFIQYLNNLNARSDKGGSIYAIERKDLYRDNKGKLRFYPPMPLDEFRVEAKRHLENILVSIKAKNKVVTRNVNITKAKKAEKGKRKRIQPTPRGRLHNETIYGRIRQYATKEEKVNASFTEDKIMTVACKHYREALLMRLRQHDGDAKKAFTGKNSLAKNPLFTDNMHTEIVPEKVKTVTLAPLYTKREAISPDLKIDKVIDIGIKRLLQKRLEQYGGDMQKAFSNLDENPIWLDEEKGISIKRVTISSVSNAEALHDKRDNHGQLILDKDGKKQPTDFVQTSGNHHVAIFRDAEGNLQEHMVSFYEATARAIQHLPIIDKEYNKDLGWQFLFTMKQNEYFVFPNEETGFNPKEIDLLDPQNYALISPNLFRVQKLSSKDYFFRHHLETKVEYNKELSGITWKRINTLSKIKDIVKVRINPVGQIVSVGEY

SEQ ID NO: 7909 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLINKLQRRYGFSKEYASIMSKISFDNDYGNLSAKAIMRILPHLRNGLQYSDDCNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNENTGFNPAEIDLLNPDNNKIISPNLFRVQKISPGDYFFRHHLETTVDANNALKGTTWIRITSLKALENVIKVRVNNIGQIVTVGEY

SEQ ID NO: 7910 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVVSLLRKGKNNIPDFYRSDLVAEFDKIWNFQRQFYPDVLTDSLKEELKGKGDKETWAICSKPFAIEGIKRNIKGWEQKKEDYAWRAESLQHKIDLERLAIVLQKVNGQIKNSSGYLGAISDRSKELFFNKLTVGQYQMAELDKNPNFSLKNQVFYRQDYLDEFERIWETQAKFHKELTPELKHFIRDIIIFYQRPLKSQKGLISLCELESREIEIERDGKKTKKTIGPRVCPKSSPMYQEFRIWQAINNLQVSGMVVADNQVDLFGKTIGKKFGKRFLEQEEKEILFKELNFKSKLTKKEILKLLFENYKELDLNYNEVKGNTTMAALLEACSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLPRNSLRNPVVEKILNQMINVVNAVVDTYGRPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRVVPTTGSVTSRLREDWQLVDMMKELNWDKYDKLGLTEIIEDKDGRRIRHIKDWTKRNDQRHHAMDALTIAFTKPAFIQYLNNLYARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYGGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVIWKRIKSLGKIKDIVKVRINQIGKIEDLGEY

SEQ ID NO: 7911 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTGSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7912 - protein, 1388 aa, unidentified
  REGION 1..1388: note = Description of Unknown:uncultivated organism sequence
MKKILGLDLGTSSIGWAIVNEKENEGEQSSIIKLGVRVNPLTVDEQRNFEAGKPITTNADRTLKRSMRRNLQRYKLRRESLLEILKSNHFITEETMLAENGNRTTFETYRLRAKAAVEEISLEELARVLLMINKKRGYKSSRKVNADDEGKIIDGMDVARKLYDENITPGQYVLDTMRRGKRYIPDFYRSDLIAEFDRIWNFQKQFYPEILTDELREELKNKNKKQTWAICAKSFSLVGIKRETKGNELKKENYQWRVESISKQTDLERLTIILQEINGQISSSSGYLGEISDRSKELYFKRQTIGQYLMERLDTNPNYSLKNKVFYRQDYLDEFEKIWETQAKFHAELTDKLKREIRDVVIFYQRPLKSQKGLISFCEFENKQIEVTVDGKKKLKTIGMRVCPKSSPLFQEFKVWQILNNIQVSGEIVPAQDTDLFGTTSRMEQGKRFLYQDEKETLFYELNIKEKMSKNEALKLLFKNYKELDLNYKEIEGNRTMAALIKACQTIIDMSGHGEYDFSKMRAKDVMHIIETIFNGLGFNTDILHFDASVEGKAFDKQSAYMLWHLLYSFAGDNSKSGNEKLINKISELYGFDKEYAAIIAGINLQQDYGSLSSKAMRKILPHMKDGLEYSVACGYAGYRHSSESLTREELDNKVLKERLGLLPRNSLRNPVVEKILNQMINVVNSVVEEYGKPDEIRIELARELKKSASEREELTKAINKTTKEHEEYKKILQREFGIVNVSRNDIIRYKLYMELKDNGFKTLYSNTYIPQEKLFSKEFDIEHIIPQAKLFDDSFSNKTIESRAINIEKSNATAYDFVCSKYDSEEIKRYEVRIEELFRKGIISKTKRDKLMMREADIPDGFIERDLRDSQYIAKKAREILCDIAREVVTTTGSVTSRLREDWQLVDVMKELNWDKYDKLGLTEIIEDKDGRRIRRITDWTKRNDHRHHAMDALTIAFTKRSYIQYLNNMNARSDKSSSIYAIEKNELYRDNGKLKFCSPIPLDVFRAEAKRHLDNILVSIKAKNKVVTRNLNVTKTRNGKNKKMQLTPRGQLHNETIYGKIKQYVTKEEKVNAAFTEEKIATVANQKYRMALLERLKRYNGNSKKAFTGNNTLQKNPIFLDDMHTMTVPEKVTTVTFEDVYTIRKEISPDLKIDKVIDVHVREILKARLAEYGNDPKKAFVNLKDNPIWLNKEKGIDIKRVTIRGVSNAVALHDKHDNKGRLVLDNDGGKQPVDFVSTSNNHHVAIYRDADGNLQENVVSFYEATMRANMGMPIIDKDYKKAEGWQFLFTMKQNEYFVFPNEESGFNPNDINLFNADNYAEISKNLFRVQKLATKDYFFRHHLETTVIDSNILKGITWKRCNLSSIKDIVKVRVNHIGQIVAVGEY

SEQ ID NO: 7913 - protein, 1394 aa, unidentified
  REGION 1..1394: note = Description of Unknown:uncultivated organism sequence
MKHILGLDLGTNSIGWALVKERENENEQSSITRLGVREIYLTADEQSNFEKGKSITTNADRTLKRSMRRNLQRYKLRRNSLISLLKDYGFITAETLLNENGNRTTFETYRLRAKAVTEEISLEELARVLLMINKKRGYKSSRKAKSNDESGQLIDGMEVAKKLYDDNLTPGQYVVSLLRKGKNNIPDFYRSDLVAEFDKIWNFQRQFYPDVLTDSLKEELKGKGDKETWAICSKPFAIEGIKRKTKGWEQKKEDYAWRAESLQHKIDLEGLAIVLQKVNGQIKNSSGYLGAISDRSKELFFNKLTVGQYQMAELDKNPNFSLKNQVFYRQDYLDEFERIWETQAKFHKELTPELKHIIRDIVIFYQRPLKSQKGLISLCELESREIEIERNGKKVKKTIGPRVCPKSSPMYQEFRIWQTINNIQVSGMVVADCQVDLFGETVGKKFGKRFLEQEEKEILFKELNFKSKLTKKEILKLLFENYKELDLNYNEVKGNTTMAALLEACSKIIEMSGHGEYDFSKMSADEITGIVFPVFSGLGFSTDIFSFDSSVEGKAFDKQPSYMLWHLLYSYEGDKSKTGNESLISKISECYGFDKEYAAVIAGISFEPDYGSLSVRAMHKILPYMKDGLGYSDACLYAGYRHSKRSLTKEEIEARPLKDKIDLLPRNSLRNPVVEKILNQMINVVNAVVDTYGRPDEIRVEMARELKKTKTQREETVKAIRKTTAENEKYKKELEEEFGLKNVSRNDIVRYRLYLELKDNGFKTLYSNTYIPREKLFSKEFDIEHIIPQAKLFDDSFSNKTLEARSVNLDKADSTAYDYVKVKYGEDGLEKYKEKINQLCEKKIISKTKLKRLLTTEKDIPDGFINRDLSNTQYIARKACEILEEITRRAVPTTGSVTSRLREDWQLVDMMKELNWDKYDKLGLTEIIEDKDGRRIRHIKDWTKRNDQRHHAMDALTIAFTKPAFIQYLNNLNARSDKGGSIYAIERKELYRDNKGKLRFYPPMPLDEFRTEAKRHLENILVSIKAKNKVVTRNVNITKAKKAEKGKRKRIQLTPRGQLHNETIYGRIRQYATKEEKVNASFTEDKIMTVACKRYREALLVRLRQHDGDAKKAFTGKNSLAKTPLYTDSLHTETVPEKVKTVMLAPLYTKREAVSPDLKIEKVIDIGIKRLLQKRLEQYGGDMQKAFSNLDENPIWLDEEKGISIKRVTISSVSNAEALHDKRDNRGQLILDKDGKKQPTDFVQTSGNHHVAIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVTWKRINTLSKIKDIVKVRINQVGKIEDLGEY

SEQ ID NO: 7914 - protein, 1377 aa, unidentified
  REGION 1..1377: note = Description of Unknown:uncultivated organism sequence
MNHTMKRILGLDLGTNSIGWALVDEAENKEEQSSIIRLGVRVNPLTVDEQKNFEQGKSITTNAYRRLKRCMRRNLQRYKLRRKNLINCLLSNGIIQETTFLCESGNRTTFETYRLRAKAVTDEISLEEFARVLLMINKKRGYKSSRKAKSADEGQLIDGMTIAKQLYDENITPGQFVLSLLNEGKKYIPDFYRSDLQSELDRIWKYQRQFYADILTDDFKEQLKGKSKQNSSKIFLGKYQIYTADNKGKDKRLQAYRWRVEALSKQLTIEEVAFVICEINGLINNSSGYLGSISDRSKDLVFNKQTVGQALMNGLIKDPHYSLKNQVYYRQDYMDEFEAIWETQAKYHSELTPELKKEVRDIIIFYQRPLKSQKGLIGYCELENSQIEIEVDGKMKMKTIGSRVCPKSSPLFQEFKIWQILNNIKVTEKSTGACRYLEQEEKDILFFELSVKDKLSKLDVLKCLFKNYKELDLNFKEIEGNRTQSLLFKAYQDIIAMTGHKEYDFSKMSAHDVIKIVTDIFTGLGYRTDMLNFDSSIEGHDFDKQPMYLLWHLLYSYEGDKSNTGIDSLLAKIEELTGLEREYAKRLANITFQPDYGNLSAKAIRKILPLIKKGTEFSSACKNVGYNHSKRSQTREELEDKVYKDHLDILPRNSLRNPVVEKILNQMINLVNSVIDTYGKPDEIRLELARELKKSAKEREEMMNSINKARAEHEKYREILQKEFGISNVSRNDIIRYKLYLELKDNGYKTLYSNTYIPQEKLFSKEFDIEHIIPQARLFNDSFSNKTLESRSVNIEKSNQTAYDYVLNKYGVKDIEDYKIRIENLYKTNAISKTKRNNLLMRSTDIPDDFIKRDLRTTQYIARKACEILEDVVKFVLPTTGLITDRLREDWQLVDVMQELNWEKYDKLGLTEVLEDKDGRKLYRIKEWTKRNDHRHHAMDALTIAFTKESFIQYLNNLNAKSDKSSSIYGIEQKELYRDKHGKLRFVPPMPLDIFRMEAKYHLENTLVSIKAKNKVVTQNTNKIKLKNGFKKKVQLTPRGQLHNETIYGSMKRYVTKEEKIGAGFTVERIAKVANQKYREALLKRLFEWNGDPKRAFTGKNSLEKNPIYLDELRTWRVPVKVKTVEQETIYTVRKAIDPDLKIDKIVDGRIRQILQERLKEFGGDAKKAFGNLDENPVWLNKEKGIVIKRVTITGASSVTPLHDKKDHRGQYMLESTGRKQPVDFVNTGNNHHVAIYRDGKGNLQEKVVSFYEATSRVALGLPIIDKAYKSSEGWNFLFSMKQNEYFVFPNEEIGFNPSEIDLTDAENYALISPNLFRVQKLTSKDYVFRHHLETIVDDKKELHGITWKRLSSLNNLDKIVKVRVNHIGQIVFVGEY

SEQ ID NO: 7915 - protein, 1370 aa, unidentified
  REGION 1..1370: note = Description of Unknown:uncultivated organism sequence
MKLIFGFDLGSTSIGWAVVQEKENDTEASRILRLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRYLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNENTGFNPAEIDLLNPDNNKIISPNLFRVQKISPGDYFFRHHLETTVDANNALKGTTWIRITSLKALENVIKVRVNNIGQIVTVGEY

SEQ ID NO: 7916 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKEALVSAGIINENTCLNDSNSKELFATYVSRAKAVTEQITLEDFAKVLFMINKKRGYKSNRKTDNTESEDGQIIDGLDLAKKLKARNITPGQYLLELFKENKKNKAVFYRSDLQEELNRIWDFQSQFYPEILDNTLLSAITNKSKKAVIGLFKGIKNVEIADVKTKERTEKALTWRSEALHKQLEIGEVAYAIAEVMGAISQSSARLALLSDNSKHLEFEGLTIGQYLLKLLRNNPNSSLKNINFYRKDYEDEFNSIWNKQALFYPQLTESLRSTIFNSIFMQRNLKSCKALLANCELEFAEKKITLPDGSCQTRTIYSKVCPKSSPYFQEFQIWQSLSNIRIIDKENTHLTKGQELSYDQKVMLLPELMIHSELKANKIIEILFGKKSNYTINMPSIKGNRTNETIFNALLEIVELTGHSIDNIVKTDANQQIEAVKNIFESLGYKTDFITFDSTIEGKDGVNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGFEALEQYINRVNNLFENGKISKTKRDNLLRKQEDIPSDFLNRDLRNTEYIAKKALEILEDYVPRVTPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQAKETYIDETRKRLIKPPYDIKQFRNDAKQMLDNIFVSHKAKNKVVTPNTIVTRKKRKARKESKAEEKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKLPIIDKDFNKELGWVFQFTMKQNEMFVFPDKESGFDPLAIDLKDPANKTLISKHLYRVQKLSSCYYLFRHHLETNVEEKKELQEVAWKRIQTINNLRGIIKVRINHIGQIIDIGEY

SEQ ID NO: 7917 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7918 - protein, 907 aa, unidentified
  REGION 1..907: note = Description of Unknown:uncultivated organism sequence
MNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7919 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQAKFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7920 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNKFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTTYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRFYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTNRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETKVDDNNALKGTTWIRIRSLPALENIIKVRVNNIGQIVAVGEY

SEQ ID NO: 7921 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDVMAVARKLYDEHLTPGQYVYQLLCRGKKYIPDFYPSDLNAEFEAVWNCQKQFYADIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKAQLDLFGDTTEGAHGTRTLTEEEKSDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFERQTAYQLWHLLYSYSGDNSATGNEKLIERLRNLLNMDRDSAAVFVSIPLEPDYGSLSAKAMRRILPHMMDGLEYSVACEYAGYRHSCRSLTKEEIAAKPLVETIPLLPRNSLRNPVVEKILNQMINVVNAVSDRYGKPDEIRIEMARELKKSAKEREQMTRDIARTNAENEKYRKALQEEFGIQNVSRNDIIRYRLYVELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVDKVVDQRVRKLLQERLAEYGGDAKKAFANLDENPIWLNRERGIAIKRVTIYGVSNATALHDKRDMHGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7922 - protein, 1422 aa, unidentified
  REGION 1..1422: note = Description of Unknown:uncultivated organism sequence
MKRILGLDLGTTSIGWALVDEAESENEISGIVKLGVRVNPLTVDEMSNFEKGKSFSINEVRRIKIGMRRNLQRYKLRREFLIKSLTRRGIITDETILSESGPSSTFETYRLRAKAACERIELEEFARVLLMINKKRGYKSNRKIKDADSQGSTMINSIDVARKLYDEGLTPGELCKDLLKDGQKRLPDFYKSDLHDEFARIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVDGKEITIGAKVAPCSHPIFQEFKIWQVLNNLEVSLVEPVYAEAIYSNVFECFDNSFKSDESRKLEQEEKEVLARELFYKGDLSKSDVLKILFKKTKGLDLNFDKVSGNKTTHAIFSAFAEYFNGKKENTIDFKNSANEIEKHFKSAFDKYKINTDLLKIDLSKSNKEIEKEPLFRLWHLLYSYEGDNSVSGVEKLIEKLKELCNIDNDCAAILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKSSPNRCDPSGDEIRVELARELKKSTKEREDLNSAILKGNKENEAVREVLRKEFNISNPSKNDVIRYKLYQELKVNGYKTLYSNKKIDLGILFSNEIDIEHIIPQARLLDDSFSNKTLEFRDVNIEKGNRTAYDYVASKYGPEELEAYKKRCEAVCIEGKKAKFRKLMMTEAEIPDGFIERDLRETQYISKKALEMLNEVFKTVTATTGSITDELRNDWQLVDLMKELNLPKYEALGEVREIEDSKGHKKKVINDWTKRNDHRHHAVDALTVAFTKSALIQYYNYKNAAWIEGHKGHAVISAIKAKYFEGGKAKSPIPLTTFRAEVKRALESLLVSIKSKTKVVTKNKTRINRNNGPLEQNTLTPRGELHEETVRGRIKVPVWENEKIGEDFDAQKISRVADVRYRIALSNRLKEFNNDPKAAFTGKNSLTKKPINCGDGETVPQKVLVKHFEDVYTVRKPVDENLNIEKVLDSRIRQLLKDRVAMFKSQKEAFADLENNPIWVNKERGIVLKRVTIGEKLGNAVALHYKKNKDGKFILDKEGNKIPVDFVKTGNNHHAVIYRVPQKGKDGKLKYDKYGNLEYEIVDIVVPFYEAVRRKSEGLDVVDKNLNKEAGWEFLFSMKQNEYFVFPNEKTGFDPTKIELTDHKNYSAISPNLYRVQKFSQGYYLFRHHLETTVKNESKEMKDILYKRITSLKQFENMVKVRVNHIGEIVDVGEK

SEQ ID NO: 7923 - protein, 1393 aa, unidentified
  REGION 1..1393: note = Description of Unknown:uncultivated organism sequence
MKKILGLDLGTTSIGWALVKEAEIEEEKSSIIKLGVRVNPLTVDEQSNFEKGKAITTNADRTLKRTARRNLQRYKLRRENLLSVLKEHGFITDDSVLCEQGNRTTFETRLLRSKAATEKISLEELARVFIMINKKRGYKSSRKVNSGEEGSLIDGMTVARKLYDEHLTPGQYVYQLLCEGKKYIPDFYPSDLDAEFEAVWNCQKQFYADIFTDELREALRGKNEKQTWGICSEPLGLKGIKRNGSTADQRVENYRWRTEAISKQMPLEQVAVVLQKINGQIAGTSGYLGTISDRSKELYFNHQTVGQFQMKQLSDNPNTSLKNQVFYRQDYLDEFERIWETQAKYHSQLTADLKHELRDIVIFYQRPLKSQKGLVNYCEFESRQKEVVVDGKKKTINIGLRVCPKSSPLFQCFKIWQAINNLQVTGEVVPKAQLDLFGDTTECEHGTRTLTEEEKCDLYRELSIKESLSETEIIKLLFGSKKGLSLNFRKVEGNRTMSLFVKACQTVLVINGYNDYDFSKQPYDKAMQIITQVFEALGFNTSFLTFDPTLDGKDFERQTAYQLWHLLYSYSGDNSATGNEKLIERLRNLLNMDRDSAAVFVSIPLEPDYGSLSAKAMRRILPHMMDGLEYSVACEYAGYRHSRRSLTKEEIAAKPLVDTIPLLPRNSLRNPVVEKILNQMINVVNSVSDRYGKPDEIRIEMARELKKNAKEREQMTRDIARANAENEKYRKILQEKFNKPNVSRNDIIRYRLYLELEANGFKTLYTQTYIPREKLFSKEFDIEHIIPQARLFDDSFSNKTLEARSANIEKGSTTAYDYVLAKYGEQGDNGSVKYKERIDSLYKEGVISKTKHDKLLMTTAEIPDGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHLKDVFVSIKAKNKVVTRNVNITRGADGKKHRTVQLTPRGQLHNETIYGSRRRYVVKQEKVSSAFNEEKISTIGNPQIREALLRRLAEFGGDAKKAFTGKNSLEKNSIYLNDSHTKQVPQKVKTVTLEEVFTIRKPIDKDLNVEKVVDHRVRKLLQERLAEYGGDAKKAFANLDENPIWLNRERGIAIKRVTIYGVSNATALHDKRDMHGKKMLDSNGISIPIDYVSTSNNHHVAIFRDKDGNLQEHIVSFFEATERGQQQLPIVDYEYNKHLGWQFLFTMKRNEYFVFPNEKTGFDPNEVDLLDPNNAAEISKNLFRVQKLTTKDYFFRHHLETNVETPKELLGTTYARLSLKGIVGIVKVRVNHLGEIVAVGEY

SEQ ID NO: 7924 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHYDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7925 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNSTISAIFDAFKEIILQSGHDNNNFNKASFKDTMLIIEPIFKMLGINTDILSLDCPTDSPSLKTCPIYQLWHLLYSYVGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLRNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7926 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLVHGMRLNLSRYKQRRKELIKNLIRFKFISPDTVLCENGSNTTFETLRLRAKAATEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGCPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNLNKASFKDTMLIIEPIFKMLGISTEILSLDSPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVGLTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFEEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETNVDDNNALKGTTWIRITSLKALENVIKVRVNNIGQIVAVGEY

SEQ ID NO: 7927 - protein, 1394 aa, unidentified
  REGION 1..1394: note = Description of Unknown:uncultivated organism sequence
MKKILGLDLGTTSIGWALVKEAEIEEEKSSIIKLGVRVNPLTVDEESNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCRGKKYIPDFYPSDLNAEFEAVWNCQKQFYAGIFTDELREALRSKNEKQTWAICAEPLGLKGIKRNGSTADQRVENYRWRTEAISKQLPLEQVAVVLQKINGQIAGTSGYLGAISDRSKELYFNHQTVGQFQMKQLSDNPNTSLKNQVFYRQDYLDEFERIWETQAKYYSQLTAELKHELRDIVIFYQRPLKSQKGLISYCEFESRQKEMVVDGKKKTITIGLRVCPKSSPLFQCFKIWQTINNLQVTGEVVPKAQLDLFGDTTECEHGTSTLTEEEKSDLYRELSIKESLSETEILKLLFGSKKGLSLNFRKVEGNRTMSLFVKACQTVLAINGYNDYDFSKMSYDKAMPIITQVFEALGFNTSFLTFDPTLDGKDFERQTAYQLWHLLYSYSGDNSATGNEKLIERLRNLLNMDRDSAAVFVSIPLEPDYGSLSAKAMRRILPHMMDGLEYSVACEYAGYRHSRRSLTKEEIAAKPLVETIPLLPRNSLRNPVVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINHDLRDTQYIARKAREILESAVRVVVPTTGAVTDRLREDWQLVDVMKELNWDKYDQLGLTEIYKDPDGRQIRRIKDWTKRNDHRHHAMDALTIAFTRHSFIQYLNNLNARSDKAGSIYAIEKKELYRDNNNKLRFVPPMPLGEFRAEARRHLEDVFVSIKAKNKVVTRNVNITRGADGKKHRTVQLTPRCQLHNETIYGSRRRYVVKQEKVSSAFNEEKISTIGNPQIREALLRRLSEFGGDAKKAFTGKNSLEKNPIYLDDSHTKQVPQKVKTVTLEEVFTIRKPVDKDLNVDKVVDLRVRKLLQERLAEYGGDAKKAFANLDENPIWLNRERGIAIKRVTIYGVSNATALHDKRDMHGKKMLNSNGISIPVDYVSTSNNHHVAIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 7928 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETNVDDNNALKGTTWIRIRSLPALENIIKVRVNNIGQIVAVGEY

SEQ ID NO: 7929 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSAGIINENTCLNDSNSKELFATYVSRAKAVTEQIALEDFAKVLFMINKKRGYKSNRKTDNTESEDGQIIDGLDLAKKLKARNITPGQYLLELFKENKKNKAVFYRSDLQEELNRIWAFQSQFYPEILDNTLLSAITNKSKKAVIGLFKGIKNIEIADVKTKERTEKALTWRSEALHKQLETGEVAYAIAEVMGAISQSSARLALLSDNSKHLEFEGLTIGQYLLKLLRNNPNSSLKNINFYRKDYEDEFNSIWNKQASFYPQLTESLRSTIFNSIFMQRNLKSCKALLANCELEFAEKKITLPDGSCQTRTIYSKVCPKSSPYFQEFQIWQSLSNIRIIDKENAHLTKGQELSYDQKVMLLSELMIHSELKANKVIEILFGKKSNYTINMPSIKGNRTNETIFNALLEIVELTGHSIDNIVKTDANQQIEAVKNIFESLGYKTNFITFDSTIEGKDGLNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGAEALEQYINRVNNLFENGKISKTKRDNLLRKQEDIPSDFLNRDLRNTEYIAKKALEILEDYVPRITPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQAKETYIDETRKRLIKPPYDIKQFRNDAKQMIDNIFVSHKAKNKVVTPNTIVTKKKRKAGKETKAEEKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERIVGLPIRPKRNINGEIMKDELGQPLKSHYVATGGNHHVAIYEDEEGKWHEKVVSFNEAASRAIQKFPIIDKDFNKELGWVFQFTMKQNEMFVFPDKESGFDPLAIDLKDPANKTLISKHLYRVQKLSSCYYLFRHHLETNVEEKKELQEVAWKRIQTINNLRGIIKVRINHIGQIIDVGEY

SEQ ID NO: 7930 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSSGIINENTCLNDSNSKELFATYVSRAKAVTEQIALEDFAKVLFMINKKRGYKSNRKTDNTESEDGQIIDGLDLAKKLKARNITPGQYLLELFKENKKNKAVFYRSDLQEELNRIWAFQSQFYPEILDNTLLSAITNKSKKAVIGLFKGIKNVEIADVKTKERTEKALTWRSEALHKQLEIGEVAYAIAEVMGAISQSSARLALLSDNSKHLEFEGLTIGQYLLNLLRNNPNSSLKNINFYRKDYEDEFNSIWNKQASFYPQLTESLRSTIFNSIFMQRNLKSCKALLANCELEFAEKKITLPEGSCQTRTIYSKVCPKSSPYFQEFQIWQSLSNIRIIDKENTHLTKGQELSYDQKVMLLPELMIHSELKANKVIEILFGKKSNYTINMPSIKGNRTNETIFNALLEIVELTGHSIDNIVKTDANQQIETVKNIFDNLGYKTNFITFDSTIEGKDGLNQPYYKLWHLLYSYCGDNSKTGNEALIRKIEELTGLEKEEAKVLSNCTFENDYASLSTKAIRKLLPHLQSNLDYSEACEAAGYNHSKRSRTKEDIKNKTYKDELDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGSEALEQYINRVNNLFENGKISKTKRDNLLRKQEDIPSDFLNRDLRNTEYIAKKALEILEDYVPRVTPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQAKETYIDETRKRLIKPPYDIKQFRNDAKQMLDNIFVSHKAKNKVVTPNTIVTKKKRKAGKETKAEKKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKFPIIDKDFNKELGWVFQFTMKQNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 7931 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSAGIINENTCLNDSNSKELFATYVSRAKAVTEQIALEDFAKVLFMINKKRGYKSNRKTDNTESEDGQIIDGLDLAKKLKARNITPGQYLLELFKENKKNKAVFYRSDLQEELNRIWAFQSQFYPEILDNTLLSAITNKSKKAVIGLFKGIKNIEIADVKTKERTEKALTWRSEALHKQLEIGEVAYAIAEVMGAISQSSARLALLSDNSKHLEFEGLTIGQYLLNLLRNNPNSSLKNINFYRKDYEDEFNSIWNKQASFYPQLTESLRSTIFNSIFMQRNLKSCKALLANCELEFAEKRITLPDGSCQTKTIYSKVCPKSSPYFQEFQIWQSLSNIRIIDKENTHLTKSQELSYDQKVMLLPELMILSELKANKIIEILFGKKSNYTINMPSIKGNKTNETIFNALLEIVELTGHSIDNIVKTDANQQIEAVKSIFESLGYKTDFITFDSTIEGKDGLNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQPVNGEKSNQTAFDFISKKYGSEALEQYINRVNNLFENGKISKTKRDNLLRKQEDIPSDFLNRDLRNTEYIAKKALEILEDYVPRVTPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQAKETYIDETRKRLIKPPYNIKQFRNDAKQMLDNIFVSHKAKNKVVTPNTIVTKKKRKAGKETKAEEKRTFLTPRGALSNETVYRKICNYETKEITINSKLTYEIALTIAKKKEREAVLERLAQHNNNPTTAFKNYNKNPIMLQTSVGEKPLISVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRSIQKLPIIDKDFNKELGWVFQFTMKQNEMFVFPDKEAGFDPLAIDLKDPANKSLISKHLYRIQKISSGDYYFRHHLETNVEENKEVKGITWKRITSLSPLQGIIKVRINHIGQIIDIGEY

SEQ ID NO: 7932 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTKANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVGLTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYDFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7933 - protein, 1390 aa, unidentified
  REGION 1..1390: note = Description of Unknown:uncultivated organism sequence
MKKILGLDLGTTSIGWALVNEKENDNEQSSIIKLGVRVNPLSVDEQSNFEKGKAITTNADRTLKRSARRNLQRFKLRRENLLTLLKEHGFITDETVLCEQGNRTTFETRQLRARAVSEEITLEQLARVLLMINKKRGYKSSRKADSGEDGKLIDGMSVARQLYEQHLTPGQYVLNLLRNGKKYLPDFYPSDLTAELKAVWHAQQAYYPELLTQELFDALKNKNEKQTWAICAQPFDIKGMKRNGTTAEQKAENYRWRSEALDKKIGLEELAIVLQKINGQIHGTSGYLGAISDRSKELYFNHQTVGQYQMQLLEKDPDTSLKNQVFYRQDYLDEFERIWETQATYHPELTAELKHEIRDIVIFYQRQLKSQKSLVGYCELESKPKEVVVDGKKKTITTGLRVCPKSSPLFQSFKIWQTLNNVQVSGNIIPEKQLDLFGTAATYKYGSRCLTEEEKQTLYKELSLKERMSAAEILKLLFKSGKGLSLNFREVDGNRTMAAFVKACQTIIVMSGHNEYDFAKLSYETVVSTINQIFNALGIKSGFLNFDPCLEGKAFEHQPAYQLWHLLYSYAGDNSATGNEKLITRIAETFGMEHNYAAVFATITFMPDYGNLSAKAMRRILPYMMDGNEYSVACEYAGYRHSRRSLTKEELDKKPLVDTLPLLPRNSLRNPVVEKILNQMINVVNEVSAQYGKPDEIRIEMARELKKSAKEREQMTADITRATAQQEEYRRILQDKFGMPHVSRNDIIRYRLWLELKDNGYKTLYSQTYIPREKLFSKEFDVEHIIPQARLFDDSFSNKTLEARQANLEKSDATAFDYVQSKYGEKGAKEYKERIDYLYADGVISKTKHDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTKHSFIQYLNNLNARSNKAGSIYAIEQTCLYRDAHGKLRFMPPMPLDVFRAEARRLLQDILVSTKAKNKVVTRNINSIKRRGEKKQTVQLTPRCQLHNETVYGSVRCCVVKEEKISSSFTEEKIATVASPRYREALLKRLGENGGNTKKAFTGRNSLEKNPLYLNDDHTLSVPAKVKTVTYETIFTQRKPIDKDLKVDKVIDEHVKEILEARLKEFGGDAKKAFSNLDDNPIWLNRERGIQIKRVTIRGVSNAVALHDKHDVQGKPMCDSEGRRMPSDYVSTSNNHHVAIFRDANGNLQEHVVSYFEATARAIQHLPIVDRDYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 7934 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSAGIINENTCLNDSNSKELFATYVSRAKAVTEQIALEDFAKVLFMINKKRGYKSNRKTDNTESEDGQIIDGLDLAKKLKARNITPGQYLLELFKENKKNKAVFYRSDLQEELNRIWAFQSQFYPEILDNTLLSAITNKSKKAVIGLFKGIKNVEIADVKTKERTEKALTWRSEALHKQLEIGEVAYAIAEVMGAISQSSARLALLSDNSKHLEFEGLTIGQYLLKLLRNNPNSSLKNINFYRKDYEDEFNTIWKKQASFYPQLTESLRSTIFNSIFMQRNLKSCKALLANCELEFAEKKITLPDGSCQTRTIYSKVCPKSSPYFQEFQIWQSLSNIRIIDKENTHLTKGQELSYDQKVMLLPELMIHSELKANKIIEILFGKKSNYTINMPSIKGNRTNETIFNALLEIVELTGHSIDNIVKTDANQQIEAVKNIFESLGYKTDFITFDSTIEGKDGLNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGSEALEQYINRVNNLFENGKISKTKRDNLLRKQEDIPSDFLNRDLRNTEYIAKKALEILEDYVPRVTPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQAKETYIDETRKRLIKPPYDIKQFRNDAKQMLDNIFVSHKAKNKVVTPNTIVTKKKRKAGKETKAEEKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEELDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKLPIIDKDFNKELGWVFQFTMKQNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 7935 - protein, 1382 aa, unidentified
  REGION 1..1382: note = Description of Unknown:uncultivated organism sequence
MKRILGLDLGTASVGWAVVNEAENSEEQSSITALGSRVVLLSADEKNNFLTGKSVSATATRTAKRGARRNLQRYKLRREWLKDALVSAGIINENTCLNDSNSKELFATYVSRAKAVTEQIALEDFAKVLFMINKKRGYKSNRKTDNTESEDGQIIDGLDLAKKLKARNITPGQYLLELFKENKKNKAVFYRSDLQEELNRIWAFQSQFYPEILDNTLLSAITNKSKKAVIGLFKGIKNIEIADVKTKERTEKALTWRSEALHKQLETGEVAYAIAEVMGAISQSSARLALLSDNSKHLEFEGLTIGQYLLKLLRNNPNSSLKNINFYRKDYEDEFNSIWNKQASFYPQLTESLRSTIFNSIFMQRNLKSCKALLANCELEFAEKKITLPDGSCQTRTIYSKVCPKSSPYFQEFQIWQSLSNIRIIDKENAHLTKGQELSYDQKVMLLSELMIHSELKANKVIEILFGKKSNYTINMPSIKGNRTNETIFNALLEIVELTGHSIDNIVKTDANQQIEAVKNIFESLGYKTNFITFDSTIEGKDGLNQPYYKLWHLLYSYCGDNSKTGNEALIRKIEELTGLEKEEAKVLANCTFENDYASLSTKAIRKLLPHLQSNLDYSEACEAAGYNHSKRSRTKEDIKNKVYKDKLDLLPRNSLRNPIVEKILNQMIHVINQTSEAYGKPDEIRIEMAREIKKNKIQREKLANQLRQNTAELERIKDILRKDFKLSHISHNDILRYRLYEELSLNGYKTLYSNTYIERQQILDPTVTIEHIVPKALAFDDSFSNKTLEIQSVNGEKSNQTAFDFISKKYGAEALEQYINRVNNLFENGKISKTKRDNLLRKQEDIPSDFLNRDLRNTEYIAKKALEILEDYVPRITPTIGEITKTLREDWQLVNIMRELNWEKYNSLGLTSFYYDRNGTKIGLIHNWTKRNDHRHHAMDALTIAFTKPSIIQYLNNLKSQNDKGSSIYAIQVKETYIDETRKRLIKPPYDIKQFRNDAKQMLDNIFVSHKAKNKVVTPNTIVTKKKRKAGKETKAEKKRTFLTPRGALSNETVYRKICNYETKEITINSKLTYEIALTIAKKKEREAVLERLAQHNNNPTTAFKNYNKNPIMLQTSVGEKPLMSVKIVNYKELFVKRSEINEKLDIKRVLDAKVRARLTDRLKEYNNDPKAAFANLEENPIWLNEEKGIALKHVTTIERVVGLPIRPKRNINGEIMKDEQGQPLKSHYVATGGNHHVAIYEDEEGKWHEKVVSFNEAASRAIQKFPIIDKDFNKELGWVFQFTMKQNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 7936 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFGELSIRKKLTCAEILKLLHKDSKCSLNYKEIQGNATISAIFDAFKEIILQSGHDNNNFNKASFKDTMLIIEPIFKMLGINTDILSLDCPTDSPSLKTCPIYQLWHLLYSYVGDNSKTGDSSLIKKLQRRYGFSKEYASIMSKISFDNDYGNLSTKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLRNGKISRTKHKYLLMSESEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7937 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLGRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTGSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETNVDDNNALKGTTWIRIRSLPALENIIKVRVNNIGQIVAVGEY

SEQ ID NO: 7938 - protein, 1066 aa, unidentified
  REGION 1..1066: note = Description of Unknown:uncultivated organism sequence
MSQLNRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNTTISAIFDAFKEIILQSGHDNNNFNKASFKDTMLIIEPIFKMLGINTDILSLDCPTDSPSLKTCPIYQLWHLLYSYSGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 7939 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRDLYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQEREITVDGKKKIIEFGPKVCPKSSPIFQEFKIWQTINNLKISNIYGEELSLSSDERQILFEELSIRKKLTCAKILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRELLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNENTGFNPAEIDLLNPDNNKIISPNLFRVQKISPGDYFFRHHLETTVDANNALKGTTWIRIRSLPALENIIKVRVNNIGQIVAVGEY

SEQ ID NO: 7940 - protein, 1370 aa, unidentified
  REGION 1..1370: note = Description of Unknown:uncultivated organism sequence
MKLIFGFDLGSTSIGWAVVQEKENDTEASRILKLGVRVNPLTTDEKTNFEKGKPITTNANRRLAHGMRLNLSRYKQRRKELIKSLIRFKFISPDTVLCENGSNTTFETLRLRAKAATEEITLEELSRVLLMINKKRGYKSNRKAQPNDNGAIDNIDIAKKLYQSHLTPGEYVFNNLKQGIQYIPPFYRSDLINEFNKIVDCQTQFYPHLKNIDTGSLLKAKNCDIILDGQDVQRIKQKGSPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFEKQKREITVDGKKKIIEFGPKVCPKSSPIFQEFKIWQTINNLKISNIYGEELSLSSDERQILFEELSIRKKLTCAEILKLLHKDSKCSLNYKEIQGNATISAIFDAFKEIILQSGHDNNNFNKASFKDTMLIIEPIFKMLGINTDILSLDCPTDSHSLKTCPIYQLWHLLYSYAGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRRAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7941 - protein, 1370 aa, unidentified
  REGION 1..1370: note = Description of Unknown:uncultivated organism sequence
MKLIFGFDLGSTSIGWAVVQEKENDTETSRILKLGVRVNPLTTDEKTDFEKGKPITTNANRRLAHGMRLNLSRYKQRRKELIKNLIRFKFISPDTVLCENGSNTTFETLRLRAKATTEEITLEELSRVLLMINKKRGYKSNRKAQPNDNGAIDNIDIAKKLYQRHLTPGEYVFNNLKQGIQYIPPFYRSDLINEFNKIVDCQTQFYPHLKNIDTGSLLKAKNCDIILDGQDVQRIKQKGCPSEKKRELYCLRAQAATQQIRLEELALVLEKISSEIRNSSGYLGDISDRSKELFINNQTIGQYLMSQLDRNPNNKLKGQVFYRQDYEDEFNRIWETQARFHKELTPERLHIIRDIIIFFQRDLKSQKSNIAICEFENQKREITVDGKKKIIEFGPKVCPKSSPIFQEFKIWQTINNLKISNIYGEELSLSADERQILFEELSIRKKLTCAEILKLLHKDSKCSLNYKEIQGNTTISAIFDALKEIILQSGHDNNNLNKASFKDTMLIIEPIFKMLGINTDILSLDCPTDSPSLKTCPIYQLWHLLYSYTGDNSKTGDSSLIKKLQRRYGFSKEYASIMSKISFDNDYGNLSAKAIMRILPHLRNGLQYSDACNAAGYNHSKRSLTKQDILNKVLVSQIDLLPRNSLRQPVVEKILNQLINITNALISTYGNPDEIRIELARELKKSADERAKLNSANNANEKENNSIRKLLQERFGIQNPSRNDIVRYKLYKELEHTGFKTLYSQSLITDDILFSKEIEIEHIIPQARLFDDSLSNKTLEFHNINQNKSNQTAYDYILSEFGEDYAVQYKKRIDDLLKNGKISRTKHKYLLMSETEIPTDFINRDIRETQYISRKAMEILEPATRKVVASSGAITARLREDWQLVDVMKELNWEKYKALNLTETIQDKDGRRIYKIKDWTKRNDHRHHAMDALTVAFTKPSFIQFLNNLNARSDKGNAIYAIQQKELHRNKDGKLCFNPPLPLDEFRAEAKRQLNDIFVSHKAKNKVATRNSYMTKNGKGTKIVELTPRGQLFNETTYGCVKQYETKLESVNSSFDTDKIMTVADKSYRQALMKRIEEFDGNASLAFSRKNSITKNPIYVDDSHSDTVPVKVKTVVPKPVFTQRIAVDIKLDKTKIAQILDAKIRRILTDRFYEFGEDPQKAFSNIDENPIWLNKEKGIAIKKVTIKTGISGVPIRHKRNNMGRPILNSDGNKIPSDFVVPGNNHHIAIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 7942 - protein, 1385 aa, unidentified
  REGION 1..1385: note = Description of Unknown:uncultivated organism sequence
MGTTSIGWALVNEGENDNEKSSIVKLGVRVNPLSSDEKNEFETGKALTTNAERTNKHGMRINLQRYKQRRANLVRCLKENGIIDDETLLFEHGNSSTFQTYRARAKAVDEEISLADFSRVLLMVNKKRGYKSNRKAKDTDDGELIDGMTVAKELHSKGLTPGQFLMMRQKEGKKFRQEFYRSDLQNELDRIWDNQKTFYPDVLTDDMKSEIAGVNAKQCSAIFYNRKNVVTAKNNGKDSYETKLQWRCECLTGKRDIEQVAYVISSLCGEISNSSGRLAMISDRSKDLYFNNQTIGQYLMTLIDGNPNASLRNITFYRQDYIDEFNAIWQCQSKYHKELTPALKDEIEKHIIFYQRDLKSCKSLVNHCEFEQSEKEIAVDGKKRKITIGLRACPKSSPLFQTFRTWQKLNDIMVSPSDGKNKSSAMNSVPGLFNDLKTWKPERFLKQEEKEKLFEELSVKGKLTKNEALCILFGKANGLEMNFREVEGNQTMAAIYGACRDIISQSGNGEYDFRKMSAAEIKSTVNEIFGRLGYDTSFLDFDPLSEGKALERQSSYRLWHLLYSYAGDKSVTGNDALLERIGELCGLDRESAGIMAKVSFAEDYGKLSAKAMRKILRYMMKGVGYSAACEEAGYKHSPRSLTKEELKAKVYAGKMDVVKRNSLRNPVVEKILNQMVNVVNGIIDTYGKPDEIRIEMARELKQSREDRAEKDKAIRDATKEQNIIRKTLEEDFHIANVTKNDILRYRLYEELKMNGYKTLYSCTYIPIEELFSKKFEIEHIIPKARLFDDSFSNKTLETSGVNKDKGDMTAYDFVAMKHDEKYLADYEARVNELFKQKKISKAKRDKLLMREADIPKDFLNRDLNDTQYIAKTAREMLEDIVPEVLTTTGKITSRLREDWGLVDVMKEINWDKFDKLKMTVTEHDRDGRPIKRIMDWTKRNDHRHHAMDALTIAFTKRAIIQYLNNVNARSDKGSSIYGIEKKYMKRNERGRLVFVPPMPSGKLREEARRQLDMILVSVKAKNKVVTKNINKTKKNGGVNKKEQLTPRGKLHNETVYGKIARYQTEMKRVGGSFTEDVVLSVADKRIREALYERLAEHDFNPKEAFTGSNSLTKKPLWLDKEHSRCVPEKVKTVILEPICTIRKPVDKDLNIDKVVDVRVKEILKQRLKEYGGVAAKAFSNLEENPIWLNREKGIAIKRVNILDSKNNVAIHGKHDIAGRPMLDEDGKPVGNDYVNTSNNHHVAIFTDSEGNLQEHVVSFYEATAMAILGYPVVDRQYNKGLGWKFLFSMKQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 7943 - protein, 1390 aa, unidentified
  REGION 1..1390: note = Description of Unknown:uncultivated organism sequence
MKKILGLDLGTTSIGWALVNEKENDNEQSAIIKLGVRVNPLSVDEQSNFEKGKAITTNADRTLKRSSRRNLQRFKLRRENLLTLLKEHGFITNETILCEQGNRTTFETRRLRARAVTEEITLEELARVLLMINKKRGYKSSRKADSGEDGKLIDGMTVARQLYDEHLTPGQYVFNLLRKGKKYLPDFYPSDLTAELKAVWRTQQTYYPELLTQELYDAIKNKNEKQTWAICAKPFGINGMKRNGTMAEQTIENYRWRTEALEKKIGLEELAIVLQKINGQIRGTSGYLGEISDRSKELYFNHQTVGQYQLQLLEQNPNTSLKNQVFYRQDYLDEFERIWETQASYHPELTTELKHEVRDIVIFYQRQLKSQKGLVGYCELENDTKEVVVDGKKKTVTIGLRVCPKSSPLFQCFKIWQTINNVQVSGNIIPEKQLDLFGTVAAYKYGSRCLTEEEKQTLYKELSLKERMKATEILKLLFKNAKGLSLNFHEVDGNRTMAAFVKACQTIISMSGHNEYDFAKLPHETTVSTITQIFDVLEIKSDFLNFDPCLEGKTFEQQPAYQLWHLLYSYAGDNSATGNDKLIAHIAKTFGMKHEYAAVFAAITFTPDYGNLSAKAMRRILPHMMDGNEYSIACEYAGYRHSRRSLTKEELDKKPLVDSLPLLPRNSLRNPVVEKILNQMINVVNGVSAQYGKPDEIRIEMARELKKSAKEREQMTADIARATAQQEEYRRILQDEFGLQHVSRNDIIRYRLWLELKDNGYKTLYSQTYIPREKLFSKEFDIEHIIPQARLFDDSFSNKTLEARQANLEKSNTTAFDYVLNKYGEEGAKEYEKRIGSLYSDGVISKTKRDKLLMKEADIPEGFINRDLRDSQYIARKAREILESMVRVVVPTTGAVTDRLRDDWQLVDIMKELNWDKYDKLGLTETFKDHDGRQIKRIKDWTKRNDHRHHAMDALTIAFTRHSFIQYLNNLNARSNKAGSIYAIEQTCLYRDGYGKLRFVPPMPLDVFRAEARRQLQNILVSTKAKNKVVTRNINTIKCKGEKKKTVQLTPRCQLHNETVYGSMRCCVVKEEKIGSTFTEEIIATVASPRYREALLKRLAEYGGNAKKAFTGRNSMEKNPIYLNDDHTLCVPAKVKTVAYETIFTQRKPIDKDLKVDKVIDEHVQKILQARLNEFGGDAKKAFSNLDENPIWLNRERGIQIKRGTIRGVSNAVALHDKHDVQGKTMCDSEGRRMPSDYVSTSSNHHVAIFRDADGNLQEHVVSYFEATARAIQHLPIVDRDYKKAEGWQFLFTMKRNEYFVFPNEKTGFNPKEIDLLDPKNYAVISANLFRVQKLATKDYFFRHHLETSVKEEKLLFDITWKRCRSPKELQGTIKVRVNNIGQIVAIGEY

SEQ ID NO: 7944 - protein, 1393 aa, unidentified
  REGION 1..1393: note = Description of Unknown:uncultivated organism sequence
MENVKHTSMKKILGLDLGTNSTGWALVNEAENTAEKSSITKLGVRIIKYDNFVNTETGSESKEPEKDFCGGKGISPNAGRTKGRSARRNLQRYKLRRANLIEYLKKCGLITDSAVLCENGNRTTFQTYRLRAMAVTEEISLEELSRVFLMINKKRGYKSSRKAKLPDEGQLIDGMAVAEQLYENDLTPGQFVFSILQQGKKSIPEFYRSDLQNELNRIWDHQKQFYPEILTDEFRKQIEGEGRPNTAKMFLGKYKIYTADIKGKDKRLQAYQWRSNALTSQLSIDEVAFVVSELNGAINNASSYLGAIGDRSKELRFNKLTVGQYLMKQLDKDPNYSLKNQVFYRQDYLDEFEAILEKQAQYHPELTPELKKDIRDIIIFYQRPLKSQKGLVSFCEFESRQIEVNVDGKQKLRTIGCKVCPKSSPLFQEFKIWHTLHSLIVKEKKTNAERFLYQEEKETLFAELNIKETLSKLDALKLLYKNYKDLDLNYDKIEGNRTQAALFKAYQTIISMTGHGEYDFSKMMSDEVMEIVEGVFSGLGYNTDILHFDAENELFDKQPMYMLWHLLYSYEGDKSSTGNKSLIDKIFKLCGFEKEYASIIANIIFQSDYGSLSTKAIRKILPRMKEGNEYSLACEYAGYRHSQRSLTKDELDNKVYKDHLDLLPRNSLRNPVVEKILNQMINVVNFVVDAYGKPDEIRIELARELKKSSKERKEMTMAINKTTADHEKYRQILQKEFGLTNVTRNDIIRYKLYLELKSNGYKTLYSNTYIPQEKLFSKEFDIEHIIPKTKLFDDSFSNKTLESRRVNIEKSNLTAYDYVLGVYDEKGINDYEIRIENLYKSGIISKAKRDKLMMKEVDIPSGFIERDLRDSQYIAKKAREILEELVRFVVPTTGTITDRLREDWQLIDVMQELNWEKYDKLGLTEIVKDKDGRQIRRIKDWTKRNDHRHHAMDALTVAFTKRSYIQYLNNLNAKSDKSGSIYAIEQKELYRDKHGKLRFNPPMPLDVFRAEAKRQLENTLISIKARNKVVTQNVNITKTKKTESGYRKKIQLTPRGQLHNETFYGAIKRYVTKLESVGSGFNVEQIALVANKRYREALLTRLAACGNDPKKAFTGKNSLEKNPLYLDELHTQQVPTKVKTVTLETVYTTRKDISSDLKIEKVIDRKVRSILKERLKKFGGDPKKAFSNLDANPIWLNKEKGISIKRVTITAVSKAEPLHAKRDHFGKYILDANGAKQPVDYVNTGNNHHVAIYRDEKGVLQERVVSFYEATASASVGLPVVDKEYRKSEGWTFLFSMKQNEYFVFPNEKNGFNPNEIDLMDPDNYALISPNLFRVQKIASKDYVFRHHLETTVEDRKELQNITWKRFQSLTNLDKLVKVRVNHIGQIVSVGEY

SEQ ID NO: 7945 - protein, 1393 aa, unidentified
  REGION 1..1393: note = Description of Unknown:uncultivated organism sequence
MKKILGLDLGTTSIGWALVKEAEIAEDKSSIIKLGVRVNPLTVDEQSNFEKGKAITTNADRTLKRTARRNLQRYKLRRENLLSVLKENGFITDDSVLCEQGNRTTFETRLLRSKAATEKISLDELARVLIMINKKRGYKSSRKVNSGEEGSLIDGMAVARKLYDEHLTPGQYVYQLLCGGKKYIPDFYPSDLNAEFEAVWNCQKQFYAEIFTDELREALRSKNEKQTWAICAEPLGLKGIKRNGSTADQRVENYRWRTEAISKQMPLEQVAVVLQKINGQIAGTSGYLGAISDRSKELYFNHQTVGQFQMKQLSDNPNTSLKNQVFYRQDYLDEFERIWETQAKYHSQLTAELKHELRDIVIFYQRPLKSQKGLISYCEFESRQKEMVVDGKKKTITIGLRVCPKSSPLFQCFKIWQTINNLQVTGEVVPKTQTDLFGDSTECEHGTRTLTEEEKCDLYRELSIKESLSETEILKLLFGSKKGLSLNFRKVEGNRTMALFVRACQTVLAINGYNDYDFSKMSYDKAMPIITQVFEALGFNTSFLTFDPTLDGKDFERQAAYQLWHLLYSYSGDNSATGNEKLIERLCAILNMDRDSAAVFASITFEPDYGSLSAKAMRRILPHMMDGLEYSVACEYAGYRHSRRSLTKEEIAAKPLVETIPLLPRNSLRNPMVEKILNQMINVVNAVSDRYGKPDEIRIEMARELKKNAKEREQMTRDIARTNAENEKYRKALQEEFGIQNVSRNDIIRYRLYLELEANGFKTLYTQTYIPREKLFSKEFDIEHIIPQARLFDDSFSNKTLEARSANIEKGSTTAYDYVLTKYGEQGDNGSVKYKERIDSLYKEGVISKTKHDKLLMTTAEIPNGFINRDLRDTQYIARKAREILESAVRVVVPTTGAVTDRLREDWQLVDVMKELNWDKYDQLGLTETYKDPDGRQIRRIKDWTKRNDHRHHAMDALTIAFTRHSFIQYLNNLNARSDKAGSIYAIEKKELYRDNNNKLRFVPPMPLGEFRAEARRHFEDVFVSIKAKNKVVTRNVNITRGADGKKHRTVQLTPRCQLHNETIYGSRRRYVVKQEKVSSAFNEEKISTVSSPQIREALLRRLSEFGGDAKKAFTGKNSLEKNPIYLDDSHMKQVPQKVKTVTLEEVFTIRKPIDKDLNVEKVVDLRVRKLLQERLAEYGGDAKKAFANLDENPIWLNRERGIAIKRVTIYGVSNATALHDKRDMHGKKMLDSNGISIPVDYVSTSNNHHVAIFRDKDGNLQEHVVSYFEATERAQQQLPIVDYEYNKHLGWQFLFTMKRNEYFVFPNEKTGFDPNEVDLLDQKNAAEISKNLFRVQKLATKDYFFRHHLETNVDTPKELSGITYARLSLKGIVGIVKVRVNHLGEIVAVGEY

SEQ ID NO: 7946 - protein, 807 aa, unidentified
  REGION 1..807: note = Description of Unknown:uncultivated organism sequence
MKKILGLDLGTNSIGWALVNESENENENSSIIKLGVRVNPLTVDELTNFEKGKSITTNADRTLKRSMRRNLQRYKLRKENLNEILKKNGFINDETILSENGNKTTFETYRLRAKAVNEEVPLDQFARILLMINGKRGYKSSRKAKSQDEGQLIDGMEIAKKLYNENITPGQLVYQILKAGKKYIPDFYRSDLQNELDKIWVFQKQFEPEILTDDFKKQITGKGKMNTTKIFLARFGIYTAENKGSDKRLQAYQWRIDGLTKQLTKEELAFVISDVNGTISGSSGYLGSISDRSKELFFNKQTVGQYLMVQLEQNPHTRLKNQVFYRQDYLDEFNTIWEAQAKFHKELTNELKSEIRDVIIFYQRRLKSQKGLVSICEFENRQIEVEIDGKKKIKTVGSKVCPKSSPIFQEFKIWQILNNIQVIDKTGAKRFLDQEEKDILFRELNLKDKISKKDALKLLYENHKELDLNFKDIEGNRTMASLFKAYQTIIELSGHGEYDFSKMKSVDIIEIVVPVFKSLNYNTDILYFNSNLEGKKIEIQPLYQFWHLLYSFEGDSSNTGNEKLITKITELYGFEKEYATILANVAFQPDYGSLCTKAIRKILPHLKEGNEFSIACVNAGYRHSKSSLTRKELDDKVLKDNLEILPKNSLRNPVVEKILNQMINVVNAAIESYGKPDEIRIELARELKKSAEEREQATNAINKATLDHEIYKGILQKEFGLSHVSRTDIIRYKLYKELETRGYQTLYSNTYISPNKLFSKEFDIEHIIPQSRLLMILFQIKRLKAGVSILKKAMKQLLIMCIPNKVI

SEQ ID NO: 7947 - protein, 1394 aa, unidentified
  REGION 1..1394: note = Description of Unknown:uncultivated organism sequence
MKRILGLDLGTTSIGWALVNEKESDNEQSSIVRLGVRVNPLTVDEKANFEKGKSITTNADRRMKRSMHRNLQRYKLRRKNLIECLIENGIISEDTPLFELGNKSTFNTYKARAKAVEEEISLEDFARILLMINKKRGYKSSRKIKETEEGELVDGMEIAKKLYQEDITPGQLLLELYQQGKKNRPAFYRSDLQAEFDKIWDVQSKFYPAILSQEFKKTVTGLNKTQTSGTFFSIKSISTTKNSGKEAYAQALRWRTEALSKQLDIEEVAYVLADINGAINNSSKRLAMISDRSKELYFNHLTVGQYLMKSLELNPHTSLKNIIFYRQDYLDEFETIWEKQAQFHHELTSELKKDIRDIVIFYQRNLKSCKNLVSYCELEHQEKEVVIDGKKKVIFTGCKVCPKSSPLFQDFKIWQVLNNLEVSVAEHKPKKAKEQSQASLFGSAEMGSIRRFLEQEEKEKLFKELSVKDKMNKKEILKLLFDNPQSLDLNYKEVEGNRTNAAFIKAYQDIISFTGNGEYDFSKMKADDILALITEIFQGLGYRTDFLTFNPLLNGKDFEQQPYYRLWHLLYSYAGDNSTTGNEALIKKIGEICGFEKEYANILANIALPLDYSSLSAKAIRKILPHMMDGYEYSKACELAGYRHSARSLTKQELAAKVYKDRLDILKRNSLRNPVVEKILNQMINVVNEIIDTYGKPDEIRIELARELKKSQEERALLDEAIRKTTADSEKYRKELETEFGIQHVTKNDILRYRLYLELKPIGFKTPYSNTYIPREELFSKRFDIEHIIPKARLFDDSFSNKTLEVRDVNIEKGNMTAIDFVSGKYDEQGVAEYESRVEELYAHKAISRTKRNKLLMKEADIPADFLERDLRDSQYIAKKAREILEGIVPFVVTTTGTVTSRLREDWQLVNLMQELNWNKYAALGLTESYTDKNGNVVRHIKDWTKRNDHRHHAMDALTIAFTKRSIVQYLSNLNARSDKGSSIYGIEQKELHRDEKGHKLVFNAPMPLDEFRAEARKHLESILVSIKAKNKVVTKNINRAKKKNGHQEKVQLTPRGALHNETVYGKIKNYEAEYRKVDGKFSEETILRVCNLKYRNALLKRLSEFNNDPKKAFTGKNSLEKNPLWLNEDHSHCVPTKVKLYRIVDVFTIKKAVDKDLKIDKVIDKKIRERLQARLDEFNGDAAKAFANLDENPIWLNQEKGIAVKRVKIRGIANGEPIRIKRDVRGNSIKDANGNTIPNDYVNTANNHHVAVFRDAAGNLQEHVVSFYEATTRAIMGYPIVDKDYNSDEGWKFLFSMKQNEYFVFPNPKTGFNPQEIDLLDEKNMPLVSPNLYRVQKFTTGDYVFRHHLETNVESDNVLRDVTWKRIRSIKELESIVKVRVNHIGIIVAVGEY

SEQ ID NO: 7948 - protein, 1398 aa, unidentified
  REGION 1..1398: note = Description of Unknown:uncultivated organism sequence
MKKILGLDLGTTSIGWALVNEKENDHEKSEIIRLGVRVNPLTVDEKTNFEKGKSITTNADRRMKRSMHRNLQRYKLRRKNLIECLLEHHIISDDTPLFELGNKSTFQTYRARAKAATEEISLEDFARVLLMINKKRSYKSSRKVKDGEEGELIDGMEIAKRLYEENLTPGQLLLDLYNKGKRNRPTFYRSDLQAEFDKIWEAQAKYYPNILTDDFKSSIHGFNKTQTSGAFYGVHQIYTAKNSGKEGYAQSLAWRTEALTHQLGIEEVAYVLADINGAINNSSKRLAMISDRSKELYFNHQTIGQYLMHRLDENPNNSLTNIIFYRQDYMDEFEAIWEKQSQYHSELTPELKREIRDIIIFYQRDLKSCKNLVSYCELEHTEREITIEGKKKTILTGCKVCPKSSLLFQDFKIWQILNNLQVSVIGRQRKRIKKDKTQLSLFDDAETGALNRFLTQEEKDILYKELSIKEKMTKRDILKQLFDNHNSLDLNYKEVEGNRTMAALFKAYQDIISLTGNGEYDFSKMPADDVINVTTEIFNGLGYKTDFLSFNPLLEGKVLEQQPAYRLWHLLYSYTGDKSSTGNDALLMRIQELCGFEKEYATVLANVSLALDYGSLSAKAIRKILPHMMKGYEYSEACKMAGYNHSARSITKEELANKEYKSHLDEIKRNSLRNPVVEKILNQMINVINEIVKTYGKPDEIRIEMARELKKSREERELLDAAIRRNTAESEKLRQELEEEFGIQHVTKNDILRYKLYNELKLNGYKTLYSNTYIPREELFSKHFDIEHIIPQSRLFDDSFSNKTLEVRDINIEKGNKTAYDFVAEKYDEQGLTDYESRVEELFNNKVISRTKRNNLLMKEAEIPSDFLNRDLRDSQYIARKAREILEEMVPFVVTTTGAVTSRLREDWQLVNIMQELNWDKYDALGLTERYTDKNGNIVKRIKDWTKRNDHRHHAMDALTIAFTKRSIVQYLSNMNARSDKSGSIYGIEQKELHRDERDHKLVFNAPMPLDEFRAEAKKHLESILVSIKAKNKVVTKNINKAKTKDGHQQKIQLTPRGALHNETVYGKIRNYEAESRKVDGKFTEETILRVCNQKCREALLKRLAEFDNDPKKAFTGKNSLEKNPIWLNAEHSYAVPLKVKLYKIVDVFTIKKAVDKDLKIDKVIDNKVREILQARLDEYHGDAAKAFSNLDENPIWLNQEKGIAIKRVKIKAKVSSDTSLPLHIKKNLLGNILKDDEGAAIPTDYVNTANNHHVAIFVDSEGNWHEHVVSFFEATASAMLGLPIVDKNYKREEGWKFLFSMKQNEYFVFPNEKTGFVPKEIDLTDPKNYPLISPNLYRVQKFSSLFYIFRHHLETNVEEPNALRDTTWKSIRSVKNLENVIKVRVNHIGCIVSVGEY

SEQ ID NO: 7949 - protein, 1395 aa, unidentified
  REGION 1..1395: note = Description of Unknown:uncultivated organism sequence
MKKILGLDFGTTSIGWALVNEKENDDEKSSIIRLGVRVNPLTVDEKTNFEKGKSITTNADRRMKRSMHRNLQRYKLRRNNLIECLKEHGIITDETPLFEHGNQSTFTTYRARAKAVEEEISLEDFARVLLMINKKRGYKSNRKIKDTEEGELVDGMEIAKRLYEENLTPGQLLLDLLQKGKKNKPTFYRSDLQAEFDKIWEVQSAYYSEVLTDDFKKQISRFNKTQTSGAFYAFYKIATAKNSGKEGYGQALLWRVAALTKKLDIEEVAYVLCDINGAINNSSKRLAMISDRSKELYFSHQTVGQYLMQSIEQNPNASLKNIIFYRQDYMDEFETIWEKQAQFHSELTPELKKEIRDIVIFYQRDLKSCKNLVNYCEFERAEREVVVDGKEKTIVTGFKVCPKSSPLFQDFKIWQILNNLQVSVTGHQRKRIKKDESQLSLFADTEGEPLQRFLDQEEKDILFKELSVREKMTKKEILKLLFDNPQKLDLNYKEVEGNRTMATLFKAYQEIISLTGNGEYDFSKMPADKVLTVTSEIFTGLGYKADFLVFNPLLEGKEMEKQPAYRLWHLLYSYTGDNSTTGNEALLMRILDICGFEREYATILANVAMPLDYGSLSAKAIRKILPFMMKGYEYSKACEMAGYKHSARSLTKEELDNKEYKSRLDGLKRNSLRNPVVEKILNQMINVVNEISATYGKPDEIRIELARDLKKSQEERELLDQAIRKNTTEGEKLRKELEEEFGIQHVTKNDILRYKLYNELKMNGYKTLYSNTYIPREELFSKRFDIEHIIPKARLFDDSFSNKTLEVRDINIEKGDMTAYDYVANRYDEKGLADYESRVEELYVQKVISKTKRNNLLMKEADIPSDFLQRDLRDSQFIARKAREILEDMVPFVVTTTGSVTSRLREDWQLVHLMQELNWEKYDALGLTESYTDKNGNIVRRIRDWTKRNDHRHHAMDALTIAFTKRSIVQYLSNLNARSDKSSSIYGIEQKELNRDNKEHKLVFNAPMPLNEFRAEARKHLESILVSIKAKNKVVTKNINRAKKKDGHQQKIQLTPRGALHNETVYGRITNFEAEYKKVDGKFTEETILRVSNQRYREALLKRLAAFDNDSKKAFTGKNSLEKNPIWLNADHSYCVPLKIKLYKKVDVFTIKKVVDKDLKIDKVIDNKVREILQQRLDEYGGDAAKAFSNLDDNPIWLNKEKGIAIKRVKIRGIANGEPVRYKRNVKGEIIQDEKGNPVPNDYVNTANNHHVAVFRDSEGKLQEHVVSFYEATTRAIMGYPIVDKEYKRSDGWQFLFSMKQNEYFVFPNEKTGFNPQEMDLLDADNYAIISPNLYRVQKFTDGDYFFRHHLETSVENENSLKGVTWKRITSVHNLSGIIKVRVNHIGRIVSVGEY

SEQ ID NO: 7950 - protein, 1395 aa, unidentified
  REGION 1..1395: note = Description of Unknown:uncultivated organism sequence
MKKILGLDLGTTSIGWALVNEKVNDNEKSSIIQLGVRVNPLTVDEKTNFEKGKSITTNADRRMKRSMHRNLQRYKLRRKNLIECLKEHGIITDNTPLFELGNQSTFKTYRARAKAVEEEISLEDFARVLLMINKKRGYKSNRKIKDTEEGELVDGMEIAKRLYDGNLTPGQLLFDLLQKGKKNRPAFYRSDLQAEFDRIWEVQSAYYPEVLTTDFKKHINGFNKTQTSGAFYAIHQISTTKNSGKDGYQQALLWRVAALMKKLDIEEVAYVLSDINGAINNSSKRLAMISDRSKELYFNRQTVGQYLMRSIEQNPNASLKNIIFYRQDYLDEFEAIWEKQAQYHSELTPELKKEIRDIVIFYQRDLKSCKNLINYCEFEHTEREVVIDGKKKTIVTGCKVCPVSSPLFQVFKIWQILNNLQVSVTGHQRKRIKKNESQLSLFADTEGEPLQRFLDQEEKDILFKELTIRDKMSKKDILKLLFDNPQKLDLNYKEVEGNRTNAILFKAYQDIISLTGNGEYDFSKMPADEVMSITSEIFSGLGYKTDFLTFNPLLEGKEMEKQPAYRLWHLLYSYAGDNSATGTEALLDRIHEICGFEKEYATVLASVSLPLDYRSLSAKAIRKILPFMMKGYEYSKACELAGYNHSARSLTKEELDNKVYKSHLDELKRNSLRNPVVEKILNQMINVVNEIAATYGKPDEIRIELARDLKKSQEERELLDQAIRKNTAESEKLRKELENEFGIQHVTKNDILRYKLYNELKMNGYKTLYSNTYIPREDLFSKRFDIEHIIPKARLFDDSFSNKTLEVRDVNIEKGDMTAYDYVAGKYDEKELADYESRVEELFVLKVISRTKRNNLLMKEEDIPSDFLQRDLRDSQYIARKAREILEEMVPFVVTTTGSVTSRLREDWQLVNIMQELNWEKYDALGMTESYTDRNGNIVRRIKDWTKRNDHRHHAMDALTIAFTKRSIVQYLSNLNARSDKGSSIYGIEHKELNRDNKDHKLVFNAPMPLDEFRAEAKKHLESILVSIKPKNKVVTKNINKAKKKDGHQHKIQLTPRGALHNETVYGKIANYEAEYRKVDGKFTEDVILRVSNQKYREALLKRLAEYGGEPKKAFTGKNCLEKNPMWLNAEHSYCVPLKVKLYKITDVFTIKKPVDKDLKIDKVIDSKVRQILQQRLNEYGGDAAKAFSNLDEHPIWLNEEKGIAIKRVKIRGIANGEPVRYKRNIKGEMMKDEKGNYIPNDYVNTANNHHVAVFKDAEGRLREHVVSFYEATTRAIMGYPIVDREYKRSEGWQFLFSMKQNEYFVFPNEKTGFNPQEIDLLDVGNYPLISPNLYRVQKFSEGDYFFRHHLETSVESENALRDVTWIRVRAIQYLNGIVKVRVNHIGKIVSVGEY

SEQ ID NO: 7951 - protein, 1404 aa, unidentified
  REGION 1..1404: note = Description of Unknown:uncultivated organism sequence
MRIIKLKSIIMKKILGLDLGTTSIGWAVVNEKENNDEESSIIRLGVRVNPLTVDEKTNFEKGKSITTNADRRLKRSMRRNLQRYKLRRENLIECLLEHHIISENTPLYETGNFSTFDTYRLRAKAVNEEISLEEFARVLLMINKKRGYKSNRKVKDGEEGELIDGMEISKRLYDESITPGQLLLDLATKGKKIRPTFYRSDLQDEFDKVWTKQSEFYPDILTDEFKSSIRGFNKTQTSGAFYGIHKISTAKNNGKDSYIQGLKWRVTALTERLGIEEAAYILADINGAINNSSKRLAMISDRSKQLFFNHLTIGQFLVKRLNDNPNASLKNIIFYRQDYMDEFETLWEKQAQYHPELTPELKKEIRDIIIFYQRDLKSCKNLVGYCELEHSTREVIIDGKVQKIITGCKVCPKSSPLFQDFKIWQILNNLQVSVSKQKQLRRKADKQQQSLFNDLDFDNPQRFLTQEEKDILFYELSFKEKMSQKDVLKLLFDNPKELELNYKDVEGNKTMASLYKAYQEIINISGHGEYDFSKMQADDILSITKQIFSGLGYKTDYLTFNPLLEGKEMERQPLYRLWHLLYSYNGDQSVTGNEALLKKINEICGFEKEYATILANISMPLDYGNLSAKAIRKILPHMMKGFEYSEACSEAGYKHSARSLTKEELEQKQYKSQLDEIRRNSLRNPVVEKILNQMINLVNEIVKTYGKPDEIRIELARELKKNQEERALLDEAIRKNTVENETLRKELENNFGFVHVSRNDILRYKLYKELKMNGYKTLYSNTYIPKEELFSDRFDIEHIIPKSRLFDDSFSNKTLELKSVNLEKGNMTAYDYVEGKYDESYLSNYESRVEDLFSQKVISRTKRNNLLAKESEIPSDFLQRDLRDTQYIARKAREILEDMVPIVVTTTGSVTDRLREDWQLINIMQELNWSKYEKIGLTDQYTDRNGEVHRYIKDWTKRNDHRHHAMDALTIAFTKSSIVQYLNNLNAKSDKSSSIYAIEKNELHRNEKSKLVFNSPMPLHLFRSEAKRQLENILVSFKAKNKVITKNINKIKTKEGGQKKVQLTPRGALHNETIYGRIRRYEAEYKKVDGKFTEDIILRVSNRNYQKALLERLSEYGYDPKKAFTGKNSLEKNPIWLNDDHTNCVPLKVKLFKVVELYTIKKSIDKNLKIDKVIDDKVREILQKRLNEFGGDASKAFSNLDENPIWLNKEKGIAIKSVKIKGIANGEPLRFKRDVKGDALKDGNGALVPNDYVSTSNNHHVAIYQDTDGKLQQRIVSFYEATTRALMGLPIVDKEYRQSEGWQFLFSMKQNECFVFPNKDSISNPKDVNLMNPKNFALISPNLYRVQKITDGDYFFRHHLETNVETENKLKGITWLRITSVQNLEGVVKVRINHIGDIVSIGEY

SEQ ID NO: 7952 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLVECLLAHHIIKDDTPLFELGNNTTFQTYRARAKAVTEEISLEDFARVLLMINKKRGYKSSRKVKDGEEGELIDGMEIAKRLYDENLTPGQLLLDLHNKGKRNRPTFYRSDLQAEFDKIWEFQSTFYPNILTDEFKSSIHGFNKSQTSGAFYGVHQISTARNSGKEGYVQALMWRTEALKRQLGIEEVAYALADINGAINNSSKRLAMISDRSKELYFNHLTIGQYLMQILNENPNHSLTNIIFYRQDYMDEFEAIWEKQAQYHPELTLELKKEIRDIIIFYQRDLKSCKNLVSYCELEHSEREITIDGKTKTILTGCKVCPKSSFLFQDFKIWQMLNNLQVFVVGRQRKKIKKDKTQPSLFDDVETGALNRFLTQEEKDILYNELSIKEKMSKREVLKLLFDNSNSLDLNYKEIEGNRTMATLFKAYQDIISLTGNGEYDFAKMSSKEVLTITTEIFKGLGYKTDYLTFNPLLEGKALEQQPSFRLWHLLYSYTGDKSATGNEALMKKIQELCGFEKEYATILANISLALDYGSLSAKAIRKILPYMMKGYEYSEACSLAGYKHSARSLTKDELVNKEYKSHLDEIRRNSLRNPVVEKILNQMINVINEIIKTYGKPDEIRIEMARELKKSKEERELLDAAIRKNTAESEKLRKELEEEFGIQHVTKNDILRYKLYNELKMNGYKTLYSNTYIPREELFSKRFDIEHIIPQSRLFDDSFSNKTLEVRDINIEKGNKTAYDYVAEKYDEQGIVDYESRVEELFSNNAISRTKRNNLLMKEADIPSDFLNRDLRDSQYIARKAREILEELVPFVVTTTGSVTSRLREDWQLVNIMQELNWDKYDALGLTEHYTDKNGNIVKRIKDWTKRNDHRHHAMDALTIAFTKRGIVQYLSNMNARSDKSGSIYGIEQKELHRNEKDHKLVFNAPMPLDEFRAEAKKHLKSILVSIKAKNKVVTKNINRAKMKDGRQQKIQLTPRGALHNETVYGKIRNYEAEYRKVDGKFTEDVILRVCNQRQREALLSRLTEYDNDPKRAFTGKNSLEKNPIWLKADHSYAVPLKVKLYKIVDVFTIKKAVDKDLKIDKVIDLKIRSILQARLNEYNGDASKAFANLDENPIWLNQEKGIAIKRVKIRAKVSSETSVPLHVKKDLLGNILKSSDGIALPTDYVNTASNHHVAIFIDAEGNWHEHVVSFYEATACAMLGLPIIDKNFKSEEGWKFLFSMKQNEYFVFPKEKTGFVPTEIDLTDPENYAQISPNLYRVQKFSSSFYVFRNHLETNVEEPTMLKDTTWKSIRSIRNLDGVVKVRVNHIGEIVEVGEY

SEQ ID NO: 7953 - protein, 1332 aa, unidentified
  REGION 1..1332: note = Description of Unknown:uncultivated organism sequence
MHRNLQRYKLRRKNLIECLLKNSIITESTNLFEHGNYTTFQTYRARAKAVEEEISLEELARVLLMINKKRGYKSNRKIKDTEEGELIDGMEIAKRLYDENLTPGQLLLDLLQQRKKSKPVFYRSDLQAEFNKIWEVQSSFYPDVLNDDFKKSIRGFNKTQTSGAFYARHKITTAKNSGKDGYAQALTWRTEALEKRLNIEEVAYVLCDINGAINNSSKRLAMISDRSKELYFNHQTVGQYLVQQIEKSPHTSLKNIIFYRQDYLDEFETIWEKQAQYHPELTPTLKKEIRDIIIFYQRDLKSCKNLVSYCELEHQEKEIEVEGKKKLITIGCKVCPKSSPLFQDFKIWQILNNLQVSVAGHQRKRIKKDDRQLSLFADTEGEPLQRFLDQEEKDILYKELYTRDKMNKKEILKLLFENPQNLDLNYKEVEGNNTMASLFKAYQEIISLTGNGDYDFSKMKTDEVIALCTEIFKGLGYKTDFLVFNPLLDGKAMEQQPAYRLWHLLYSYAGDKSATGNEALLKRIKEICGFEEEYATILSNASMELDYGSLSAKAIRKILPYMMKGYEYCKACELAGYRHSARSLTKEELDKKEYKSHLDGLKRNSLRNPVVEKILNQMINVVNEIVTTYGKPDEIRIELARELKKSQEEREELDKAIRKTTTESEELRKQLEEEFGIQHVTRNDILRYRLYNELKLNGYKTLYSNTYIPREELFSKRFDIEHIIPKARLFDDSFSNKTLEVRDINIEKGDMTAYDYIARKYGDEEITKYESRVEELFTQKVISGTKRKNLLMKESDIPSDFLQRDLRDSQYIARKAREILEEMVPFVVTTTGSVTSRLREDWQLVNLMQELNWEKYNALGLTESYTDKNGNVVRHIKDWTKRNDHRHHAMDALTIAFTKRSIVQYLSNLNARSDKGSSIYGIEQKELNRDNKERKLVFNAPMPLNEFRAEAKKHLESILVSFKAKNKVVTKNINKTKTKDGYKKKVQLTPRGSLHNETVYGKILNFEAEYKKVDGKFNEETILRVSNKKYRLALLKRLSIYNKDPKKAFIGKNSLEKNPIWLNADHSYCVPLKVKLFKMVDVFTIKKPVDKDLKVDKVIDKKVRDILQHRLEEFGGDATKAFSNLDENPIWLNKEKGIAIKKVKIRAKVSSDTSVPLHIKKDILGNILRDRESNIIPIDYVNTANNHHVAIFVDAEGNWHEHVVSFYEATASALLGMPIVDKNYKNEEGWKFMFSMKQNEYFVFPNEKTGFIPAETDLKNPDNYHLISPNLYRVQKFSSSFYVFRHHLETNVEEPAELRNTTWKRIQTIKYLEGIVKVRVNHIGEIVAVGEY

SEQ ID NO: 7954 - protein, 1368 aa, unidentified
  REGION 1..1368: note = Description of Unknown:uncultivated organism sequence
MKKILGLDLGTTSIGWALVNEKENDEEKSSIVRLGVRVNPLSVDEKGSLEKGKAVTVNADRTLKRSARRNLQRYKLRRKSLLDLLIKHDVISSETPLYEQSNDKYSLYRYRALAASAQIPLKEFARVLLTINKKRGYKSLRKVKNDEEGTLVDGMDVAKILYDRHITPGQYLLEFFKKGKKISPQFYRSDLLSELKTFWDEQVKYYPDMLTPELYKALEGKNISNSSKTFYAITHVDTAKNSGSERLANALMWRVDGLSKKLDKEQVAYVICNLNGEINGSSQQLNLIGDRSKALFFNNQTIGQYLWGLLQQYPNKSLANIIFYRQDYEDEFNTIWAKQAQYYPQLTDSLRSELFNTIFFQRPLKSQKGLISYCELESGNKEVIIDGKKKTITIGCKVCPKASPLFQEFKIWQQLNNVRIYISNEQRPLYLEEMQILFEELNIKGKMSSTDVLKVLGLKKKEAALNFKDLEGNSTNNSLFNAYLKIISDTGNGEYDIKKLSAKEIVEKVTEIFKGLGYKTDFLRFDATLNGKEFYSQPYYRLWHLLYSYTGDKSKTGNDALINKLSELCGFEKEYAKTLGNVTFEDDFGNLSSKAIKKILPFLKEGSQYSDACVLAGYKSHSARSLTKEELEQKNYTNHIDLIPRNSLRNPVVEKILNQMVNVVNLVSKVYGKPDEIRIEMARELKKSREERELMSNSINRNTTETERIRKILESEFHITHVSRNDILRYRLYEELKDNGYKTIYSQTYIPREEIFGPKFNIEHIIPQARLFDDSFSNKTLETVDINIEKSNDTAFDFVMKKYGEQGAVEYKTRVNDLAKRGAISQTKASKLLMKQEDIPEDFIERDLRSSQYIARKATEILSEMVPHVVATTGSITERLREDWQLVNVMQELNWDKYNRLGLTYEFTDKNGNTVHRINDWTKRNDNRHHAMDALTIAFTKPSFIQYLNNLNARSNKSGTIYAIEQKELHRDDKSNKLTFNAPMPLGEFCAEAKQQLENILVSRKAKNKVTTENVNKTKNKHGNQRKIQLTPRGSLHKEHVHGLVRRYESFEIKVNDKLTLELINQVASKQIREALLARLEEFDGDFKKAFGKLSKNPIWLDKDRQYQVPAKVKAVRFVEYFTIKKTISPDLKIDKVEDAGVRRILQERLKEYNGKANEAFTNLDENPIWLNKEKGIAIKSVKVKALNNAIAVHVKHDRAGNLMLDQNGNPIPCDFVNTGNNHHIAIFEDKDGILQEHVVSFFEATERKMQHLQVVDRDYNSEYGWRFLFSMKQDEYFVFPNKVTGFNPADYDLMDSKNYALISPNLFRVQAISVGDYYFRHHLETNVDKNLSLKDITWKRIRNANDLKGIVKVRLDHLGTIVNVGEY

SEQ ID NO: 7955 - protein, 1398 aa, unidentified
  REGION 1..1398: note = Description of Unknown:uncultivated organism sequence
MKKILGLDLGTTSIGWALVNEKESNQEKSQIIRLGVRVNPLTVDEKTNYEKGKSITTNADRRMKRSMHRNLQRYKLRRKNLIDCLLEHHIITEETPLNEQGNHTTFRTYRARAKAVTEEISLEEFARVLLMINKKRGYKSSRKVKDGEEGELIDGMEIAKRLYEENLTPGQLLLDLCKNGKKNRPTFYRSDLQVEFDRIWEVQSVFYPNILTDDFKSSIHGFNKTQTSGAFYGVHQIFTAKNSGKDGYVQSLIWRTEALKRQLDIEEVAYVLADINGAINNSSKRLAMISDRSKELYFNHQTIGQYLMQRLDENPNNSLTNIIFYRQDYMDEFEAIWEKQSQYHSELTPELKKEIRDIIIFYQRDLKSCKNLVSYCELEHTEREITIEGKKKTILTGCKVCPKSSPLFQTFKIWQVLNNLQVSVAGTPKKKNKKDKSELSIFNDVETGALNRFLTQEEKDILYSELSIKDKMSKKDVLKLLFDNPKNLDLNYKEVEGNKTMATLFKAYQDIISLTGNGEYDFSKMPADEVMAITTEIFSGLGYKTDYLIFNPLLEGKALEQQPVYHLWHLLYSYTSDKSVTGNESLLNKIQELCGFEKEYATVLSNVSFALDYGNLSAKAIRKLLPHMMKGYEYSEACKMAGYNHSARSLTKEELTNKDYKSHLDEIKRNSLRNPVVEKILNQMINVVNEIVKTYGKPDEIRIEMARELKKSQEERELLDAAIRKNTAESDKLRKELEEEFGIQHVTKNDILRYKLYNELKLNGYKTLYSNTYIPRDELFSKRFDIEHIIPQSRLFDDSFSNKTIEARDVNIEKGNMTAYDYVAEKYDEKGLLDYESRVEELFKNNVISRTKRNNLLMKEADIPSDFLERDLRDSQYIARKAREILEEMVPFVVTTTGAVTNRLREDWQLINIMQELNWDKYDALGLTERYTDKNGNIVKRIKDWTKRNDHRHHAMDALTIAFTKRSIVQYLSNLNARSDKSSSIYGIEQKELHRDEKDHKLVFNPPMPLDEFRAEAKKHLESILVSIKAKNKVVTKNINKAKIKDGHQQKVQLTPRGALHNETVYGKIRNYEAEYKKVDGKFTEETILRVSNQKYREALLKRLAEFDNDPKKAFTGKNSLEKNPIWLNKDHSYAVPQKVKLYKIVDVFTIKKAVDKDIKIDKVIDNKVRAILQARLDTYNGDATKAFSNLDDNPIWLNKEKGIAIKRVKVRAKVSSDTSVPLHVKKDLLGNILKDAEGRALPTDYVNTANNHHVAIFVDSEGNWHEHVVSFFEATTSALLGLPIVDKNYKNEEGWKFLFSMKQNEYFVFPNERTGFVPSEIDLMDAKNYPLISPNLYRVQKFSSLFYIFRHHLETNVEEPNELRDTTWKSIRSVKSLSGVIKVRVNHIGAIVAIGEY

SEQ ID NO: 7956 - protein, 1395 aa, unidentified
  REGION 1..1395: note = Description of Unknown:uncultivated organism sequence
MKKILGLDLGTTSIGWALVNEKENDNEKSGIIRLGVRVNPLTVDEKTNFEKGKSITTNADRRMKRSMHRNLQRYKLRRKNLIECLLEHHIITDKTPLFEQGNNTTFKTYRARAKAATEEISLEDLARVLLMINKKRGYKSSRKVKDGEEGKLIDGMEIAKRLYEENLTPGQLLLDLYNKGKRNRPTFYRSDLQTEFDRIWEVQAKYYPNILTNDFKDSIHGFNKTQTSGAFYGVHQIYTAKNSGKDGYGQSLVWRTEALQHQLDIEEVAYALADINGAINNSSKRLAMISDRSKELYFSHQTIGQYLMQRLDENPNNSLTNIIFYRQDYMDEFETIWEKQAQYHPELTKELKKEVRDIIIFYQRDLKSCKNLVSYCELEHKDREINIDGKKKVILTGCKVCPKSSPLFQNFKIWQILNNLQVSVVGNQRKRIKKDPNQPSLFNDAETSALNRFLTQEEKDILYNELSVKEKLSKKDVLKLLFDNPKNLDLNYKEVEGNRTMAALFKAYQDIISLSGNGEYDFSKIPADEVLSIVKEIFTGLGYKTDFLSFNPLLDGKALEQQPAYRLWHLLYSYTGDNSATGNEALLQKIKDICGFEKEYATILSNVSFALDYGSLSAKAIRKILPHMIKGYEYSEACKMAGYNHSVRSLTKEELATKEYKDRLDEIKRNSLRNPVVEKILNQMINVVNEIIKTYGKPDEIRIEMARELKKSQEERELLDAAIRKNTAESEQLRKELEEEFRIPHVTRNDILRYKLYNELKMNGYKTLYSNTYIPREELFSKRFDIEHIIPQSRLFDDSFSNKTLEARDINIEKGNMTAYDYVAGKYDEKYLADYESRIEDLFAQKVISRTKRNNLLMKEEDIPSDFLARDLRDSQYIAKKAREILEDLVPFVVTTTGAVTSRLREDWQLVNLMQELNWNKYDTLGLTERYTDKNGNIVKRIKDWTKRNDHRHHAMDALTIAFTKRSIVQYLSNLNARSDKSSSIYGIEQNELHRDEKDHKLVFNAPMPLNEFRAEARKQLESILVSIKAKNKVVTKNINKAKTKDGHQNKVQLTPRGALHNETVYGKIRNYEAEYRKVDGKFTEDVILRVTNQKCREALLKRLAEFDNDPKKAFTGKNSLEKNPIWLNAEHSYAVPLKVKLYKIVDVFTIKKAVDKDLKLDKVIDTKVRAILQQRLDEFSGDAAKAFSNLDDNPIWLNKEKGIAIKRVKIRGIANGEAIRVKRDNKGAIIKDENGNPIPNDFVNTGNNHHVAVFRDANGKLQEHVVSFYEATTRATLGYPIVDKDYKRSEGWEFLFSMKQNECFVFSNEETGFNPQDINLLDANNWSQISPNLYRVQKFTTGDYVFRHHLETNVESENALRDITWKRIRAIQNLDGIIKVRLNHLGNIVAVGEY

SEQ ID NO: 7957 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKSNFEKGKAITTNADRRMKRSMHRNLQRYKLRRKNLIECLLEHHIISDETPLYEQGNNTTFKTYRARAKAVTEEISLEDFARVLLMINKKRGYKSSRKVKDGEEGELIDGMEIAKRLYEEDLTPGQLLLDLYNKGKKNRPTFYRSDLQAEFDKIWEVQSAFYPNFLTDDFKSSVHGFNKTQTSGAFYGVHQIYTSKNSGKEGYVQSLIWRTEALKHQLEIEEVAYVLSDINGAINNSSKRLAMISDRSKELYFNHQTIGQYLMQRLDENPNNSLTNIIFYRQDYMDEFEAIWENQAQYHHELTPELKKEIRDIIIFYQRDLKSCKNLVSYCELEHSEREVTIEGKKKIILTGCKVCPKSSPLFQDFKIWQILNNLQVSVVGHQRKRIKKDKSQLSLFDDAESGALNRFLTQEEKDILYNELSIKDKMSKRDVLKLLFDNPKDLDLNYKEVEGNRTMAALFKAYQDIISLTGNGEYDFSKLPADEARSIITEIFTGLGYKTDFLTFDPQLEGKALEQQPAYRLWHLLYSYTGDNSATGNEALLAKIQDLCDFEKDYATILSNVSLVLDYGSLSAKAIRKILPHMMKGYEYSEACKMVGYNHSARSLTKEELANKEYKSRLEIIKRNSLRNPVVEKILNQMINVINEIIATYGKPDEIRIEMARELKKSQEERELLDAAIRKNTAESEKLRKELEEEFGIQYVTRNDILRYKLYNELKLNGYKTLYSNTYIPREEIFSKRFDIEHIIPQSRLFDDSFSNKTLEVRDINIEKGNMTAYDYVAGKYDEKYLVDYESRVEELFAQKVISRTKRNNLLMKEEDIPSDFLERDLRDSQYIARKAREILEELVPFVVTTTGAVTSRLREDWQLVNLMQELNWDKYDALGLTERYTDKNGNIVKRTKDWTKRNDHRHHAMDALTIAFTKRSIVQYLSNMNARSDKSSSIYGIEQKELHRDEKDHKLVFNAPMPLNEFRAEARKHLESILVSIKAKNKVVTKNINKGKKKDGHQQKVQLTPRGALHNETVYGKILNYEAEYRKVDGKFTEEVILRVSNQKCREAILKRLAEFGNDPKKAFTGKNSLEKNPIWLNADHSYAVPLKVKLYKIVDVFTIKKAVDKDLKIDKVIDNKIRTILQQRLDEFGGDAAKAFSNLDENPIWLNKEKGIAVKRVKIRGIANGEAIRVKRDIKGNIIKDENGTPIPNDYVNTGNNHHVAVFRDTEGKFQEHVVSFYEATTRAILDYPIVDKDYKRSEGWEFLFSMKQNEYFVFPNEKTGFKPQKIDLLNADNWGIISPNLYRVQKFTTGDYCFRHHLETNVESENALRDITWKRIRSIQDLDGIVKVRLNHLGNIVAVGEY

SEQ ID NO: 7958 - protein, 1393 aa, unidentified
  REGION 1..1393: note = Description of Unknown:uncultivated organism sequence
MKKILGLDLGTTSIGWALVNEKEKDNEKSSIIRLGVRVNPLTVDEKSNFEKGKSITTNADRRMKRSMHRNLQRYKLRRQHLIECLKEHGIINDTTPLFELGNHSTFKTYRARAKAVDEEISLEEFARVLLMINKKRGYKSNRKIKDTEEGELVDGMEIAKRLYDENLTPGQLLLDLYQKGKKTRPAFYRSDLQAELDRIWEVQSVFYPEILNNDFKKHISGFNKTQTTGAFYAIYSISTTKNSGKEAYAQSLRWRCDALKNQLNIETVAYVLCDINGAINNSSKRLAMISDRSKELYFNHQTVGQYLVQCIDHNPNASLKNIIFYRQDYLDEFETIWERQAQYHQELTPELKKEVRDIIIFYQRNLKSCKNLINYCEFEHTEKEILVEGKKKTIMIGCKVCPKSSPLFQCFKIWQVLNNLQVSVVGHQRKRIKKDDFQLALFADTEGEPLQRFLDQEEKDILFKELTIRDKMSKKEILKLLFDNPQKLDLNYKEVEGNNTMATIIKACQEIISLTGNGDFNFSKMPADDVLAVTTEIFSGLGYKTDFLTFNPLLEGKAMEEQPFYQLWHLLYSYAGDNSISGNEALIKKIHDLCGFEKEYATVLANVSMPLDYGNLSAKAIRKILPFMMKGYEYSKACELAGYRHSARSLTRDELSKREYTSHLSELKRNSLRNPVVEKILNQMINVVNEIVATYGKPDEIRIELARELKNSKEEREQMDIAIRKNTADSEKYRKILEEEFGIQHATRNDIIRYKLYNELKQNGYKTLYSNTYIPREELFSKRFDIEHIIPKARIFDDSFSNKTLEVRDINIEKGDMTAYDFVAGKYDEKGVLDYEKRVEELVTNNAISKTKRNNLLMKEADIPSDFLQRDLRDSQYIAKKAREILEQMVPFVVTTTGSITKRLREDWQLVGVMQELNWQKYDSLGLTETYFDKNGNVVRHIKNWTKRNDHRHHAMDALTIAFTKRSIVQYLNNMNARSDKSSSIYGIEQKELNRDNKDHKLVFNAPMPLNEFRAEAKKHLDSILVSIKAKNKVVTKNINRAKTKDGHQHKIQLTPRGALHNETVYGKIKNFEAEYRKVDGKFTEDTVFRVSNRRYREALAQRLAAFGNDPKKAFTGKNSLEKNPIWLNADHSYSVPLKVKLYKIVDVFTIKKAVDKDLKIDKVIDGRIRELLQQRLNEFNGDAAKAFSNLDDNPIWLNKEKGIAIKRVKIRGIASGEPIRVKRDAKGEIMNDEHGNPIPNDYVNTANNHHVAVFRDASGNLHERVVSFYEATTRAMMGYPIIDKDYKQAEGWQFLFSMKQNEYFVFPSDGFNPSEIDLTDPQNYSLISPNLYRVQKFSEGDYFFRHHLETTVETDNSLKNITWKRINSVKSLEGIVKVRVDHIGRIVSVGEY

SEQ ID NO: 7959 - protein, 1394 aa, unidentified
  REGION 1..1394: note = Description of Unknown:uncultivated organism sequence
MKRILGLDLGTTSIGWALVNEKESDNEQSSIVRLGVRVNPLTVDEKANFEKGKSITTNADRRMKRSMHRNLQRYKLRRKNLIECLIENGIISEDTPLFELGNKSTFNTYKARAKAVEEEISLEDFARVLLMINKKRGYKSSRKIKETEEGELVDGMEIAKKLYQEDITPGQLLLELYQQGKKNRPAFYRSDLQAEFDKIWDVQSKFYPAILSQEFKKTVTGLNKTQTSGTFYSIKSISTTKNSGKEAYAQALRWRTEALSKQLDIEEVAYVLADINGAINNSSKRLAMISDRSKELYFNHLTVGQYLMKSLELNPHTSLKNIIFYRQDYLDEFETIWEKQAQFHHELTPELKKDIRDIVIFYQRNLKSCKNLVSYCELEHQEKEVVIDGKKKVIFIGCKVCPKSSPLFQDFKIWQVLNNLEVSVAEHKPKKAKEQSQASLFGSAEMGSLRRFLEQEEKEKLFKELSVKDKMNKKEILKLLFDNPQSLDLNYKEVEGNRTNAAFIKAYQDIISFTGNGEYDFSKMKADDILALITEIFQGLGYRTDFLTFNSLLNGKDFEQQPYYRLWHLLYSYAGDNSTTGNEALIKKIGEICGFEKEYAAILASITLPLDYCSLSAKAIRNILPHMMDGYEYSKACEMAGYRHSARSMTKQELDAKAYKDHLDILKRNSLRNPIVEKILNQMINVVNEIIDTYGKPDEIRIELARELKKSQEERALLDEAIRKTTADSEKYRKELETEFGIQHVTKNDILRYRLYLELKPIGFKTPYSNTYIPREELFSKRFDIEHIIPKARLFDDSFSNKTLEVRDVNIEKGNMTAIDFVSGKYDEQGVAEYESRVEELYAHKAISRTKRNKLLMKEADIPANFLERDLRDSQYIAKKAREILEGIVPFVVTTTGTVTSRLREDWQLVNLMQELNWNKYAALGLTESYTDKNGNVVRHIKDWTKRNDHRHHAMDALTIAFTKRSIVQYLSNLNARSDKGSSIYGIEQKELHRDEKGHKLVFNAPMPLDEFRAEARKHLESILVSIKAKNKVVTKNINRAKKKNGHQEKVQLTPRGALHNETVYGKIKNYEAEYRKVDGKFSEETILRVCNLKYRNALLKRLSEFNNEPKKAFTGKNSLEKNPLWLNEDHSHCVPTKVKLYRIVDVFTIKKAVDKDLKIDKVIDKKIRERLQARLDEFNGDAAKAFANLDENPIWLNQEKGIAVKRVKIRGIANGEPIRIKRDVRGNSIKDANGNTIPNDYVNTANNHHVAVFRDAAGNLQEHVVSFYEATTRAIMGYPIVDKDYNSDEGWKFLFSMKQNEYFVFPNPKTGFNPQEIDLLDEKNMPLVSPNLYRVQKFTTGDYVFRHHLETNVESDNVLRDVTWKRIRSIKELESIVKVRVNHIGIIVAVGEY

SEQ ID NO: 7960 - protein, 1398 aa, unidentified
  REGION 1..1398: note = Description of Unknown:uncultivated organism sequence
MKKILGLDLGTTSIGWALVNEKENDREKSEIIRLGVRVNPLTVDEKTNFEKGKSITTNADRRMKRSMHRNLQRYKLRRKNLIECLLEHHIISDDTPLFELGNKSTFQTYRARAKAATEEISLEDFARVLLMINKKRGYKSSRKVKDGEEGELIDGMEIAKRLYEENLTPGQLLLDLYNKGKRNRPTFYRSDLQAEFDKIWEAQAKYYPNILTDDFKSSVRGFNKTQTSGAFYGVHQIYTAKNSGKEGYAQSLAWRTEALTHQLGIEEVAYVLADINGAINNSSKRLAMISDRSKELYFNHQTIGQYLMHRLDENPNNSLTNIIFYRQDYMDEFEAIWEKQSQYHSELTPELKREIRDIIIFYQRDLKSCKNLVSYCELEHTEREITIEGKKKTILTGCKVCPKSSLLFQDFKIWQILNNLQVSVIGRQRKRIKKDKSQLSLFDDAETGALNRFLTQEEKDILYKELSIKEKMTKRDILKLLFDNHNSLDLNYKEVEGNRTMAALFKAYQDIISLTGNGEYDFSKMPADDVINVTTEIFKGLGYKTDFLAFNPLLEGKVLEQQPAYRLWHLLYSYTGDKSSTGNDALLMRIQELCGFEKEYATVLANVSLALDYGSLSAKAIRKILPHMMKGYEYSEACKIAGYNHSARSITKEELANKEYKSHLDEIKRNSLRNPVVEKILNQMINVINEIVKTYGKPDEIRIEMARELKKSREERELLDAAIRRNTAESEKLRQELEEEFGIQHVTKNDILRYKLYNELKLNGYKTLYSNTYIPREELFSKHFDIEHIIPQARLFDDSFSNKTLEVRDINIEKGNKTAYDFVAEKYDEQGLTDYESRVEELYNNKVISRTKRNNLLMKEAEIPSDFLNRDLRDSQYIARKAREILEEMVPFVVTTTGAVTSRLREDWQLVNIMQELNWDKYDALGLTERYTDKNGNIVKRIKDWTKRNDHRHHAMDALTIAFTKRSIVQYLSNMNARSDKSGSIYGIEQKELHRDERDHKLVFNAPMPLDEFRAEAKKHLESILVSIKAKNKVVTKNINKAKTKDGHQQKIQLTPRGALHNETVYGKIRNYEAEYRKVDGKFTEETILRVCNQKCREALLKRLAEFDNDPKKAFTGKNSLEKNPIWLNAEHSYAVPLKVKLYKIVDVFTIKKAVDKDLKIDKVIDNKVREILQARLDEYHGDAAKAFSNLDENPIWLNQEKCIAIKRVKIKAKVSSDTSLPLHIKKNLLGNILKDDEGTAIPTDYVNTANNHHVAIFVDSEGNWHEHVVSFFEATASAMLGLPIVDKNYKREEGWKFLFSMKQNEYFVFPNEKTGFVPKEIDLADPKNYPLISPNLYRVQKFSSSFYVFRHHLETSVEEPAELRDTTWKRIQTIKYLDGIVKVRINNIGVIVSVGEY

SEQ ID NO: 7961 - protein, 1365 aa, unidentified
  REGION 1..1365: note = Description of Unknown:uncultivated organism sequence
MKRIIGLDLGVSSCGWAYVKEAEKEDEKSEILRIGVRVNPLTVDEQTNFEKGKSITTNAERQMKHSARINLQRYKLRREHLIDYLTKAGFINEETLLCENGNRTTFETFRLRAKAANEEISLSELARVLLMINKKRGYKSNRKANGSEEGALIDGMAVAKYLYENDITPGQYAYELKKKGKKQLPDFYQSDIMDELDKIWNFQQPFYPNILTDEFRQMLAGKSKTNSTKLFLARYSIYTAQNKEKDKGLQALKWRSDALARKLDIEQLAYVICELNGLINNASDYLGKISDRSKELFFQNLTVGQYQMKMLDENPNVSLKNMVFYRQDYLDEFERIWETQAKFHPELTRERKKEIGNMIIFYQRPLKSKKSLISICELEGKQIEVEMEGKKKTITVGSKVCPKSSPLFQEFRIWQRLNDIELTDLSTRQKYGLNQGQKELLAKELEYKTKMTKQQMLKCLSLKPKDYDMNFKEVDGNTTQAMLFEAYRKIIEMSGHGEHDFSKMSASDISTLVESVFAALGFNTSVLHFDAQAADISQDSMYQLWHLLYSYESDNSAMGNKALICRIQELFHFDSDEYAKILAGISFKPDYGSLSAKAIKKILPFMKEGNDYSTACVYAGYNHSKRSLTKEELDNKPLKDHLDILSKNSLRNPVVEKILNQMINVVNSLIDTYGKPDEIRIELARELKKSAKEREAMTDAINAANRENEEYKKILETEFHIPHVSRNDILRYKLYLELKDNGFHTLYSDTYIPREKLFSRDFDIEHIIPQASLFDDSFSNKTLESRSINIEKSNSTAYDYVKGKYGEEGAKNYKTRVEDLFKNGTISKTKMTKLLMTADDIPTDFINRDLRDSQYIAKKAREILEEIVRVVVPTTGSITDRLREDWQLVDVMKELNWDKYDQLGLTETFEDKDGNTIRRIKDWTKRNDHRHHAMDALTIAFTKPSFIQYLNNLNARSDRSQSIYGIERKELYRDKHNKLRFNPPIPLDEFRTEAKRHLQNILVSIKAKNKVVTRNVNKTKCKEGFNTKVQLTPRGQLHNETIYGSQQRYAIHEEKVGASFTAEKIATVANKKQREALMARLQAYNNDAKKAFTGKNALDKNPIWLNEAHTTSVPLKVKCLTMETIYTIRKPINKDLKLDKVVDSRIKQILQQRLDKYKGDANKAFSNLDENPIWLNQEKGIAIKRVAINAGLSKPEAIHAKKDKQGNNIPVDYVQTSNNHHVAIFADEQGHLQEHIVSFYEANSRAIQGLPIIEKDYQAELGWKFLFTMKQNEYFVFPDIENGFNPKEIDLTNVENYSIISPHLFRVQKLSSKYYVFRHHLETTVEDKSTLQEITWKRITAIDKLANIVKVRVNHIGQIVSVGEY

SEQ ID NO: 7962 - protein, 1399 aa, unidentified
  REGION 1..1399: note = Description of Unknown:uncultivated organism sequence
MKKVLGLDLGTTSIGWALVNEKENDNEKSSIIRLGVRVNPLTVDEKTNFEKGKSITTNADRRLKRSMHRNLQRYKLRRANLIECLKEHNIITEETPLFELGNKTTFSTYRNRAKAVEEEISLEDFARVLLMINKKRGYKSSRKVNNDEEGELVDGMEIAKKLYNENLTPGQLLLNLFRKGKRIRPSFYRSDLQAEFDKIWLFQSSFYPEVLTEDFKKSISNFNKGQTSGAFHNVYKISTAKNSGKGGYEQALIWRTEALTRQLDIEELAYVLSDINGAINNSSKRLALISDRSKELYFNDLTVGQYLVKQMEEHPHKSLKNIIFYRQDYMDEFEAIWEKQAQYHPELTPQLKKEIRDIIIFYQRDLKSCKQLVNYCEFEHAEKEVVIEGKRKKILTGAKVCPKSSPLFQDFKVWQNLNNLEVSVVGHRRRKTKAQNNQLFLFSEEDEGLMVDHRGLNLEEKEILFKELSVRGKMTKSEVLSLLFAKPKELDLNYKEIECNNTMVAFYKACQEVISLSGHGEYDFSKMPADKVISLTLEIFSGLGFKTDFLFFDALKSGKDLEKQPAYRLWHLLYSYSGDKSKTGDEALINKICAICGFGNNKEYAKPFANISLALDYGSLSAKAIRKILPYMMQGYEYSKACEKVGFNHSARSLTTEELKEKNYTSHLNEIRRNSLRNPVVEKILNQMINVVNEIAATYGKPDEIRIELARELKKSKEEREKLDKAIRENTNESEALRKELETDFKIKNVTRNDILRYKLYKELKLNGYKTLYSNTYIPREELFSNKFDIEHIIPKARLFDDSFSNKTIEARGINIEKGDMTAYDYVAGKYNDQQLAEYESRVEELFSKKVISRTKRNHLLMKQDEIPTDFLNRDLGDSQYIAKKAREILEAMVPMVVSTTGSITSRLREDWQLVDIMKELNWEKYNSLGLTESYTDKNGNTIRHIKNWSKRNDHRHHAMDALTIAFTKRSIVQYLNNLNARSDKSGSIYGIEKNELHRDEKDHKLLFNAPMPLDEFRAEAKKHLENILVSIKAKNKVVTKNINKVKIKGGHHNKTQLTPRGPLHNETVYGKILNFEAEYKNVDGKFTEETILRVSNQKYRAALLKRLSDYGGDPKKAFTGKNKLDKNPIWLNEDHSHCVPLKVKLFKKVDVFTIRKAIDKDLKIDKVIDCKVRDILQKRLDEFGGDAAKAFSNLEDNPIWLNKEKGIDIKRVKIRGIANGEPLRIKRDVKGNIIKDERGIAVPNDFVNTANNHHVAIFMDEKGGLHEHMVSFYEASTRAIMGLPIIDKSFNQDIAWKFLFSMKQNEYFVFPNEETGFSPHEIDLTDQNNYSLISPNLFRVQKISNGDYYFRHHLETNVEEVKELRNITWKRIRTIKELDGIVKVRINHLGIIVSVGEY

SEQ ID NO: 7963 - protein, 1398 aa, unidentified
  REGION 1..1398: note = Description of Unknown:uncultivated organism sequence
MKRILGLDLGTTSIGWALVNEKENENESSSIIRLGVRVNPLTVDEKSNFERGKSITTNADRRMKRSMHRNLQRYKLRRKNLIECLLEHHIISDETPLFEQGNNTTFQTYRARAKAVTEEISLEDFARVLLMINKKRGYKSSRKVKDGEEGELIDGMEIAKRLYEENLTPGQLLLDLYNKGKRNRPTFYRSDLQAEFDKIWEVQSAFYPNILTDDFKSSIHGFNKTQTSGAFYGVHQIYTAKNSGKEGYAQSLIWRTEALKHQLDIEEVAYALADINGAINNSSKRLAMISDRSKELYFNHQTIGQYLMQRLDKDPNNSLTNIIFYRQDYMDEFEAIWEKQSQYHSELTPELKKEIRDIIIFYQRDLKSCKNLVSYCELEHTERDVTIDGKKKTIQTGCKVCPKSSPLFQDFKIWQILNNLQVSVVGHQRKRITKDKTQPSLFDDAETGALNRFLTQEEKDILYNELSIKDKMSKRDVLKLLFDNPKSLDLNYKEVEGNRTMATLFKAYQDIISLTGNGDYDFSKMPADDAKSIIIEIFNGLGYKTDFLSFNPLLEGKALEQQPTYRLWHLLYSYTGDKSVTGNEALLVKIQELCGFEKEYASVLANISLALDYGSLSAKAIRKILPHMMKGYEYSEACKMAGYNHSARSLTKEELANKEYKSRLDTIKRNSLRNPVVEKILNQMINVINEIIKTYGKPDEIRIEMARELKKSQEERELLDAAIRKNTAESEKLRKELEEEFGIQHVTRNDILRYKLYNELKMNGYKTLYSNTYIPREEIFSKRFDIEHIIPQSRLFDDSFSNKTLEVRDINIEKGNMTAYDYVAGKYDEKYLVDYESRIEELFAQKVISRTKRNNLLMKEEDIPSDFLERDLRDSQYIARKAREILEELVPFVVTTTGAVTSRLREDWQLVNIMQELNWNKYDALGLTESYTDKNGNIVRRIKDWTKRNDHRHHAMDALTIAFTKQSIVQYLSNMNARSDKSSSIYGIEQKELHRDEKDHKLVFNAPMPLNEFRAEAKKHLESILVSIKAKNKVVTKNINKGKTRDGHQQKVQLTPRGALHNETVYGKICSYEAEYRKVDGKFTEDVILRVSNQKCREALLKRLAEFNDDPKKAFAGKNSLEKNPIWLNEDHSYAVPLKVKLYKKVDVFTIKKAVDKDLKIDKVIDNKVRTILQQRLDEFGGDAAKAFSNLDENPIWLNKEKGIAIKRVKIKAKVSADTSVPLHVKRDLFGNLLKDTEGKALPTDFVNTANNHHVAIFVDTEGNWHEHVVSFFEATTSALLGLPIIDKNYKREEGWKFLFSMKQNEYFVFPDEKTGFIPSEIDLMDSKNYPLISPNLYRVQKFSSSFYVFRHHLETNVDESNELKETTWKRITSIKGLEGAIKVRINHIGVIIAIGEY

SEQ ID NO: 7964 - protein, 1394 aa, unidentified
  REGION 1..1394: note = Description of Unknown:uncultivated organism sequence
MKRILGLDLGTTSIGWALVNEKESDNEQSSIVRLGVRVNPLTVDEKSNFEKGKSITTNADRRMKRSMHRNLQRYKLRRKNLIECLIENGIISEDTPLFELGNKSTFNTYKARAKAVEEEISLEDFARVLLMINKKRGYKSSRKIKETEEGELVDGMEIAKKLYQEDITPGQLLLELYQQGKKNRPAFYRSDLQAEFDKIWDVQSKFYPAILSQEFKKTVTGLNKTQTSATFYSIKSISTTKNSGKEAYAQALRWRTEALSKQLDIEEVAYVLADINGAINNSSKRLAMISDRSKELYFNHLTVGQYLMKSLELNPHTSLKNIIFYRQDYLDEFETIWEKQAQFHHELTPELKKDIRDIVIFYQRNLKSCKNLVSYCELEHQEKEVVIDGKKKVIFTGCKVCPKSSPLFQDFKIWQVLNNLEVSVAEHKPKKAKEQSQALLFGNAEMGSQRRFLEQEEKEKLFKELSVKDKMNKKEILKLLFDNPQSLDLNYKEVEGNRTNAAFIKAYQDIISFTGNGEYDFSKMKADDILALITEIFQGLGYRTDFLTFNPLLNGKDFEQQPYYRLWHLLYSYAGDNSTTGNEALIKKIGEICGFEKEYANILANIALPLDYSSLSAKAIRKILPHMMDGYEYSKACELAGYRHSARSLTKQELAAKVYKDRLDILKRNSLRNPVVEKILNQMINVVNEIIDTYGKPDEIRIELARELKKSQEERALLDEAIRKTTADSEKYRKELETEFGIQHVTKNDILRYRLYLELKPIGFKTPYSNTYIPREELFSKRFDIEHIIPKSRLFDDSFSNKTLEVRDVNIEKGNMTAIDFVSGKYDEQGVAEYESRVEELYAHKAISRTKRNKLLMKEADIPADFLERDLRDSQYIAKKAREILEGIVPFVVTTTGTVTSRLREDWQLVNLMQELNWNKYAALGLTESYTDKNGNVVRHIKDWTKRNDHRHHAMDALTIAFTKRSIVQYLSNLNARSDKGSSIYGIEQKELHRDEKGHKLVFNAPMPLDEFRAEARKHLESILVSIKAKNKVVTKNINRAKKKNGHQEKVQLTPRGALHNETVYGKIKNYEAEYRKVDGKFSEETILRVCNLKYRNALLKRLSEFNNDPKKAFTGKNSLEKNPLWLNEDHSHCVPTKVKLYRIVDVFTIKKAVDKDLKIDKVIDKKIRERLQARLDEFNGDAAKAFANLDENPIWLNQEKGIAVKRVKIRGIANGEPIRIKRDVRGNSIKDANGNTIPNDYVNTANNHHVAVFRDAAGNLQEHVVSFYEATTRAIMGYPIVDKDYNSDEGWKFLFSMKQNEYFVFPNPKTGFNPQEIDLLDEKNMPLVSPNLYRVQKFTTGDYVFRHHLETNVESDNVLRDVTWKRIRSIKELESIVKVRVNHIGIIVAVGEY

SEQ ID NO: 7965 - protein, 1390 aa, unidentified
  REGION 1..1390: note = Description of Unknown:uncultivated organism sequence
MKRILGLDLGTTSIGWALVNEAENSEEQSSITRLGVRVVPLTVDEQTNFEKGKSITTNADRTLKRSMRRGLQRYKLRRTALIGRLKEAGIINDDTILTENGPRTTFSTLRARAKSATEEVCLEEFARILLMINKKRGYKSSRKAQSTEDGAQIDGMEVAKKLHDEQLTPGQYVYSLLLAGKKYVPDFYRSDLQAELDAVWAFQKTFYPEILTDDFYHQLQGKSKTKTSSIFLAKYGIYTADNKGADRRLQQYRWRTEALSRELTKEELAFVIADICGAINNSSGLLGAISDRSKELFFNRQTIGQYILQRIDVDPHYSLKNQTFYRQDYLDEFERIWETQAQFHPELTPELKKDVRDIIIFYQRPLKSKKAMLDICTFENRKVEVTEDGKTRTKTVGLKVCPKSSPLFQEFKIWQILNNLEVEYEAPGEDLFDETEHRRLLSFEEMERLAHELLYKDKLNKREALAILFGKAAKKYDLNYKEIEGNRTIAALYRAFFNIFVLSGHEEYDINKLTADRIEEIASSLFRLLGFNEGILQFDASAEGHTFDQQPLYQLWHLLYSYEGDNSKTGNEALVSKLQSLCHCDREYAQVLVNVTFQEDYGSLSAKAMRKILPFMKQGLTYDKACEKAGYRHSERSRTKEELANREYLDRLELLPRNALRNPVVEKILNQMINVVNAVCEEYGKPDEIRIELARELKKNAKEREAMTQAINEANTQNEKYRKELEKEFDIKHVSRNDILRYRLYIELKDNGFKTLYSDTYISKEKLFSKDFDIEHIIPQARLFDDSFSNKTLEARDINIEKSNATAFDYVLNKWGEEKAAAYKVKIDDLYRRNVISKTKHDKLLMHETDIPEGFIDRDLRNSQYIAKKAREILEDLVPTVTPTIGSITDRLREDWQLIDVMQELNWDKYDRLGLTERYEDKDGRELRRIKDWTKRNDHRHHAMDALTIAFTHPAFIQYLNNLNARSDKGSSIYGIEQKYLYRDSHGKLRFSAPLPLDIFRAEAKRQLEDILVSIKAKNKVMTQNVNKSKVKGGTRKKVQLTPRGQLHNETIYGHTLHRVTEEVKVDGKMTLERAQQVAKKMYREAILARLAEFGGDPKKAFTGKNSPEKNPIWLNEQHAEQVPLRVKLVYYEDYYPIRKPVSPDLKIDKVIDARVRRILEERLKAFDGDAKKAFSNLDENPIYLNKEKGITIKSVRIRGVLSAISLHEAKDHFGRVITDSRGKHREVDFVQTASTHHIAIYRDADGNLQDVGVSFLEATTRKALGLPVVDTDYNAALGWKFLFSMKQNEYFIFPDVEHGFDPSAIDLYDPNNKAEISKRLYRVQKLSRVDYGKQVVREYVFRHHLETTVEETKELKKITFKNIKSLAPLEGIIKVRVNHLGDILPSKEN

SEQ ID NO: 7966 - protein, 1398 aa, unidentified
  REGION 1..1398: note = Description of Unknown:uncultivated organism sequence
MKKIIGLDLGTNSIGWAIVNEKENDSEKSSIIRLGVRVNPLTVDEKTNFEKGKSITTNADRRMKRSMHRNLQRFKLRRKNLIECMLENGIITEDTPLFESGNRSTFNTYRARAKAVEEEISLEDFARVLLMINKKRGYKSNRKIKDTEEGELIDGMEIAKKMYDEHLTPGQLLLDLLKKGKKNKPVFYRSDLQSEFDKIWEVQSVYYPDVLNEEFKQRIKGFNKTQTSGAFYAIHNVSTVKNNGKGGYEQALEWRTKAIKEKLDIEIVAYVLCDINGAINNSSKRLAMISDRSKELYFNHQTVGQYLMEIINHNPNSSLKNIIFYRQDYLDEFEAIWERQAQYHPQLTPQLKKEIRDIIIFYQRDLKSCKSLISFCEFEHKDKEIVVDGKKKTIITGYKVCPKSSPLFQDFKIWQVLNNLKVSVNSRKLKRIKRNDGQLPLFDSLDDEPGNRYLDQEEKDILYKELTFKEKMSKKDVLSLLFENPQTLDLNYNEVEGNRTMAAFFKGFQDIISLTGNGEYDFSKMPADEVLATTSDIFSGLGYKTDFLQFNPLVQGKDLDKQPLYRLWHLLYSYSGDKSITGNDALLRRISEICGFEKEYASVLANISLPIDYGSLSAKAIRKILPFMMKGLEYSEACEKAGYKHSARSLTKEELQKKEYKSHLSVLRKNSLRNPVVEKILNQMINVVNQLIDTYGKPDEIRIELSRELKKSQEERASLSDAIRKNTGESDSIRKILQDEFKIQHVTRNDILRYRLYEELKLNGYKTIYSNTYIPREELFSNRFDIEHIIPKARLFDDSFSNKTLERRDINIEKADKTAYEYVADKYDEKWLSEYETRIEELFNQKAISKTKRNHLLMKAADIPTDFLSRELRDSQYIARKAREILEDIVPIVVSTTGAITSRLREDWQLVHIMQELNWNKYDQLGETETYTDKNGETKRIIKNWTKRNDHRHHAMDALTIAFTKPSIIQYLNNLNARSDKGGSIYGIEQKELNRDNKHNKLVFNAPMPLDEFRAEAKKHLESILVSIKAKNKVVTKNVNKTKKKNGIIKTNQITPRGPLHNETVYGKIKNFVAEYKIVNGQFDESTILRVCNQRYRNALLKRLSEYDYNPKKAFTGKNSLEKNPIWLNAEHSYSVPTKIKLFKVVDVFTIRKSIDSNLKIDKVIDKKIREILQQRLDENGKDANKAFSNLNDNPIWLNEEKGIAIKRVKVKAKVSSDTSVPLHIKKDLSGNVINDDEGRVVPTDYVNTASNHHIAIFVDSNGIWQEHVVSFFEATASALLGMPIVDKSYKSEEGWKFLFSMKQNEYFVFPNKETGFNPSEIDLMDESNYPIISQNLYRVQKFSSSYYVFRHHLETNVEEQNILKGTTWKRITSIKHLEGIVKVRVNHIGRIVAIGEY

SEQ ID NO: 7967 - protein, 1398 aa, unidentified
  REGION 1..1398: note = Description of Unknown:uncultivated organism sequence
MKKILGLDLGTTSIGWALVNEKENESEQSSIIRLGVRVNPLTVDEKTNYEKGKSVTTNTDRRLKRSMHRNLQRYKLRRKNLIECLIEHHLINDDTPLFELGNGSTFNTYRARAKAVTEEISLEDFARVLLMINKKRGYKSSRKVKDGEEGELIDGMEIAKRLYDENLTPGQLLRELYEKGKKTRPAFYRSDLQAEFDKIWEIQSAFYPDILTDDFKASIRGFNKPQTSGAFYGVYKIYTAKNIGKEGYAQSLKWRTEALSRQLGIEEVAYILADINGAINNSSKRLAMISDRSKELYFSHQTIGQYLMQRLDENPNASLTNIIFYRQDYMDEFEAIWEKQAQYHPELTAELKKEIRDIIIFYQRELKSCKNLVSYCEFEHQEREVIIDGKKKMILTGCKVCPKSSPLYQDFKIWQILNNLQVSVVGYQKKKIRKESSQLSLFDDIETGSLNRFLSQEEKDILYHELSIKEKMNKKDVLKLLFDNPKNLDLNYKEVEGNRTVALLFKAFQDIISLTGNGEFDFSKMPTDDVLSTATEIFRGLGYKTDFLAFDSLLEGKALEQQPLYRLWHLLYSYTGDKSATGNVALLERIKDLCGFEKEYAIILANLPLPLDYGSLSAKAIRKILPHMMKGYEYSEACKMAGYNHSARSLTKEELATKEYKTRLDEIKRNSLRNPVVEKILNQMINVINEVVATYGKPDEIRIEMARELKKSQEERQLLEGAIRRNTTESEKLRHELETEFGIQHVTRNDILRYKLYNELKLNGYKTLYSNTYIPREELFSKRFDIEHIIPKARLFDDSFSNKTIEVRDINIEKGSMTAYDYVAGKYDEKYLSDYKSRIEELYSQKVLSRTKRNNLLMKESEIPSDFLERDLRDSQYIARKAREILEEMVPHVVTTTGAVTSRLREDWQLVNLMQELNWDKYDALGMTERYTDKNGNIVKHIKDWTKRNDHRHHAMDALTIAFTKRSIVQYLSNLNARSDKSGSIYGIEQKELHRDEKDHKLVFNAPMPLNEFRAEAKKHLGSILVSIKAKNKVVTKNINTFRSSEGQRKKVQLTPRGALHNETVYGKILNYEAEYKKVDGKFTEEVVLRVSNQRYRHALLARLNEYGNDPKKAFTGKNSLDKNPVWLSADHSHSVPQMVKLYKVVDVFTIKKPVDKDLKVDKVIDGRIRQILRERLAEFGGDASKAFSNLDENPIWLNRQKGISIKRVKVKAKVSSDTSVALHVKKDLFGNIMRNKDGQTIPVDYVNTANNHHVAIFVDEEGNWHEHVVSFYEATASALLGVPIVDKDYKREEGWKFLFSMKQNEYFVFPNEKTGFVPSEIDLTNPDNYHLISPNLYRVQKFSSSDYMFRHHLETNVDESNELKGFTWKRITSLKNLEGVVKVRVNHIGQIVNVGEY

SEQ ID NO: 7968 - protein, 1398 aa, unidentified
  REGION 1..1398: note = Description of Unknown:uncultivated organism sequence
MKKILGLDLGTTSIGWALVNEKESESEQSSIIRLGVRVNPLTVDEKSNFEKGKSITTNSDRRMKRSMHRNLQRYKLRRKNLIECLIEHHIINKDTPLFELGNGITFKTYRARAKAVTEEISLEDFARVLLMINKKRGYKSSRKVKDNEEGELIDGMEIAKRLYDENLTPGQLLLELHEKGKRTRPVFYRSDLQAELDKIWKIQSTYYPNILTDDFKTSIRGFNKAQTSGAFYGAYKIYTAKNSGKEGYIQSLKWRTEALSHKIGIEEVAYILADINGAINNSSKRLAMISDRSKELYFSRQTIGQYLMQHLDENPNASLTNIIFYRQDYMDEFEAIWEKQAQYHPELTAELKKEIRDIIIFYQRDLKSCKNLVSYCELEHQEREVVIDGKKKMIFTGCKVCPKSSPLYQDFKIWQILNNLQVSVIGYQKKKIKKEASQLSLFDDIETGSLNRFLSQEEKDILYHELSIKEKMGKKDVLKLLFDNPKDLDLNYKEVEGNRTIALLFKAFQDIISMTGNGEYDFSKMPTDDALSITTEIFRGLGYKTDYLTFDSLLEGKALEQQPSYRLWHLLYSYTGDKSTTGNVALLERIKDICGFEKEYANILANVSLPLDYGSLSAKAIRKILPHMMKGYEYSEACRKAGYNHSARSLTKEELATKNYKTHLDEIKRNSLRNPVVEKILNQMINVINEVVTTYGKPDEIRIEMARELKKSQEERQLLEEAIRKNTTESEKLRQELETEFGIQHVTRNDILRYKLYNELKLNGYKTLYSNTYIPREELFSKRFDIEHIIPKARLFDDSFSNKTLEVRDINIEKGNMTAFDYVAGKYDEKYLSDYESRIEELYSQKVISRTKRNNLLMKESEIPSDFLERDLRDSQYIARKAREILEEMVPHVVTTTGAVTSRLREDWQLVNLMQELNWDKYENLGMTERYTDKNGNIVKRIKDWTKRNDHRHHAMDALTIAFTKRSIVQYLSNLNARSDKSKSIYGIEQKELHRDEKDHKLVFNAPMPLNEFRAEAKKHLESILVSIKAKNKVVTKNINRFKNKEGQQQKIQLTPRGALHNETVYGKIQNYEAEYRKVDGKFTEEVILRVSNQKYRHALLERLAAFGNDPKKAFTGKNSLEKNPIWLNANHSHCVPAKVKLYKIVDVFTIKKAVDKDLKIDKVIDGRIRQILQERLNEFGGDASKAFSNLDENPIWLNQEKGISIKRVKIRAKVSSDTSVPLHIKKDMYGNIMKNKDGQPIPIDYVNTANNHHVAIFIDEDGNWHEHVVSFYEATASALLGLPIVDKDYKREEGWKFLFSMKQNEYFVFPNEKSGFVPSEIDLTAPENYHLISPNLYRVQKFSSSFYVFRHHLETNVDESNELKDLTWKRITSIKNLEGIVKVRVNHIGQIVTVGEY

SEQ ID NO: 7969 - protein, 1376 aa, unidentified
  REGION 1..1376: note = Description of Unknown:uncultivated organism sequence
MKKILGLDLGTTSIGWAVVNEATNDREKSSIVKLGVRVNPLTVDEQTNFEKGRPITTNADRTLKRSMRRNLQRYKLRRENLINCLKEHGFINNDSILCEHGNKTTFETYRLRAKAATEKISLQELARVLLMINKKRGYKSSRKAKSTDEGELVDGMTVAKTLYEENLTPGQYSLQLLRSGKKYLPDYYQSDLHAEMLKIWYKQQIFYPDILTPDFMKALEGKSKSNTSKIFYARFGIHTADNKSKDKKQQAYQWRVDALNRQLTIEEVAYVISDLNGLINGSSGYLGRISDRSKNLYFNKQTVGQYLMQELDKNPNYSLKNSVFYRQDYLDEFEVIWNTQSKYHPELTPELKKELGNIIIFYQRPLKSQKGLVAICELENEQREVEVDGVKKLITIGCKVCPKSSPLFQEFRMWQRLNDIVIYDSNAMPDFFGNGRATKRRLTEEEMNTLAFELSIKGKMTKQQMLKCLFGKTAGLDMNFKDIDGNETQAKLFEAYLKIIEMTGHEEYDSAKLNASQILDVVEKVFTGLGFNTAPLYFDASIKGKQFDKQPMYQLWHLLYSYEGDNSKTGDNSLIKKIRDIFNFDNDDYAKAIAAVSFKPDYGSLCAKAIRNLLPIMKKGIDYSEACKSEYGTHSKRSLTKEELDQKELKDYLDMLPKNSLRNPVVEKILNQMINVVNEVVTTYGPIDEIRIEMARKLKKSAKERERETNKINTTTAYHEEIKKILQAAPFNIEHVSHNDIIRYKLYEELKENGYKTLYSNKYIPKEKLFSREIDIEHIIPQARLFDDSFSNKTLEWRSINQEKSNATAFDYVRGKYGEAGAKEYKQRVDELRKQEVISKVKHAYLLMSVEDIPSNILNRELNDTQYIARKAREILEQIVKIVVPTTGKITKRLREDWQLVNVMQELNYPKYEKLGLSETFEKEWTKRNDHRHHAMDALTIAFTKQSIIQYLNNLNARSDKSSSIYGIEQNELYRDKHGSLRFLPPIPLDEFRSEAKLHLEQILVSIKSKTKVVTRNANKSKSKKAGKGYNKRVQLTPRGQLHNETIYGSSQRYVTKEEKVGSSFDVEKISTVTNKTYREALQHRLEAYNGDVKKAFTGKNSLEKTPIWLDDLHTRAVPIKVKCATMDTIYTIRKPISKDLRIDKVIDKHIQDILRARLEEYGGDANKAFSNLDENPIWLNEEKGIRIKSVAINAGLSKPEAIHEKRDHCGQLIFNEKGNKQAADFVQTANNHHVAIFRDAEGKLQEHIVSFYEATMRANQGWPIVDKEYNQAEGWEFLFTMKQNEYFVFPDKDFCPSEYDLMNPANYAFISPHLFRVQKLATKDYFFRHHLETTVEDKNELRNMTWKRIRNCDGLKGIVKVRVNHIGQIVAVGEY

SEQ ID NO: 7970 - protein, 1395 aa, unidentified
  REGION 1..1395: note = Description of Unknown:uncultivated organism sequence
MKKILGLDLGTTSIGWALVNEKENDDEKSSIIQLGVRVNPLTVDEKANFEKGKSITTNADRRMKRSMHRNLQRYKLRRKNLIECLKEHNIITGETPLFEQGNHSTFKTYRARAKAVEEEISLEDLSRVLLMINKKRGYKSNRKIKDTEEGELVDGMEIAKRLYDENLTPGQLLLDLLQQGKKYRPAFYRSDLQAEFNKIWEIQSAYYPEVLTDDFKKHVSGFNKTQTSGVFYAIHKISTAKNSGKEGYQQALLWRVAALTKKLDIEEVAYVLCDINGAINNSSKRLAMISDRSKELYFSHQTVGQYLMHSIEQNPNASLKNIIFYRQDYLDEFEAIWEKQAQFHPVLTPELKKEIRDIVIFYQRDLKSSKNLINYCEFEHTEREVVVDGKKKTIVTGCKVCPKSSPLFQDFKIWQILNNLQLSVVGHRRKRIKKDELQLSLFADKEGEPLQRFLDQEEKDILFKELSIRDKMSKKEVLKLLFDNPQKLDLNYKEVEGNKTNAALFKAYQNIISLTGNGEYDFTKMPADDVMSITSEIFTGLGYKTDYLTFNPLLEGKALERQPAYRLWHLLYSYTGDNSTTGVEALLKKIQEICGFEKEYATILAKVSLPLDYGSLSAKAIRKILPLMMKGYEYSKACELAGYRHSARSLTKEELDNKTYKSHLDELKRNSLRNPVVEKILNQMINVVNEIAATYGKPDEIRIELARDLKKSQEERELLDQAIRKNTAESEKLRKELEEEFGIQHVTKNDILRYKLYNELKMNGYKTLYSNTYIPREDLFSKRFDIEHIIPKARLFDDSFSNKTIEVRDVNIEKGDMTAYDYVAGKYDEKGLADYESRVEELFAQKIISRTKRNNLLMKEADIPSDFLQRDLRDSQYIARKAREILEEMVPFVVTTTGSVTSRLREDWQLVNLMQELNWEKYDTLGLTESYTDKNGNIVRRIKDWTKRNDHRHHAMDALTIAFTKRSIVQYLSNLNARSDKSGSIYGIEQNELNRNNKDHRLVFNAPMPLDEFRAEARKHLESILVSIKAKNKVVTKNINKAKKKDGHQQKVQLTPRGALHNETVYGKITNFEAEYKKVDGKFTEDVILRVSNQRYREALLKRLADFGGDSKKAFTGKNSLDKNPIWLNADHSYCVPLKVKLYKKIDVFTIKKAVDKDLKIEKVIDNKVRAILQQRLNEFGGDAAKAFSNLDDNPIWLNKEKGITIKRVKIRGIANGEPVRYKRNIKGELMKDENGNPIPNDYVNTANNHHVAVFRDAEGKMQEHVVSFYEATTRAIMGYPVVDREFKRSEGWQFLFSMKQNEYFVFPNEKTGFNPQEIDLLDADNYATISPNLYRVQKFSEGDYFFRHHLETNVESENALRDITWIRVRSIQYLEGIVKVRVNHIGKIVSVGEY

SEQ ID NO: 7971 - protein, 1398 aa, unidentified
  REGION 1..1398: note = Description of Unknown:uncultivated organism sequence
MKKILGLDLGTTSIGWSLVNEKENDNEKSEIIRLGVRVNPLTVDEKSNFEKGKSITTNADRRMKRSMHRNLQRYKLRRKNLIECLLEHHIITDETPLFEKGNNTTFQTYRARAKAVTEEISLEDFARVLLMINKKRGYKSSRKVKDGEEGELIDGMEIAKRLYEENITPGQLLLDLYNKGKRNRPTFYRSDLQAEFDKIWAMQSTFYPEILTDDFKSSIRGFNKMQTSGAFYGVHQIYTAKNSGKEGYAQALLWRTEALRHQMDIEEVAYALADINGAINNSSKRLAMISDRSKELYFDHLTIGQYLMKRLDENPNNSLTNIIFYRQDYMDEFEAIWEKQAQYHPELTQELKKEIRDIIIFYQRDLKSCKNLVSYCELEHTEREITIDGKKKTILTGCKVCPKSSPLFQDFKIWQILNNLQVSVVGRQRKKIKKDKNQLSLFDDVETGALNRFLTQEEKEILYNELSIKEKLSKKDVLKLLFDNHNSLDLNYKEVEGNRTMAALFKAYQDIISLTGNGEYDFSKMPTDEVMNITSEIFKGLGYKTDFLTFNPLLEGKSLEQQSVYRLWHLLYSYTGDKSATGNEALLNKIQDLCGFEKEYAVILSNISFALDYSSLSAKAIRKILPHMMKGFEYSEACKMAGYNHSERSLTKEELAQKEYKSHLDEIKRNSLRNPVVEKILNQMINVVNEIIKTYGKPDEIRVEMARELKKSQEERELLDAAIRKNTAESEKLRKELEEEFGIQHVTRNDILRYKLYNELKLNGYKTLYSNTYIPREELFSKRFDIEHIIPQSRLFDDSFSNKTLEVRDINIEKGNKTAYDYVSEKYDEQDVTDYESRVEELFNNKAISRTKRNNLLMKEADIPSDFLNRDLRDSQYIARKAREILEELVPFVVTTTGAVTSRLREDWQLVNIMQELNWEKYDALGLTEQYTDKNGNIVKRIKDWTKRNDHRHHAMDALTIAFTKRSIVQYLSNMNARSDKSSSIYGIEQKELHRDEKDHKLVFNAPMPLDIFRAEAKKHLESILVSIKAKNKVVTKNINKSKTKDGHQQKVQLTPRGALHNETVYGKIQNYEAEYRKVDGKFTEDVILRVSSQKHREALLKRLAEYNNDPKKAFTGKNSLEKNPIWLNADHSYAVPLKVKLYKIIDVFTIKKAVDKDLKLDKVIDNKVRAILQARLNEFDGDAAKAFSNLDENPIWLNKEKSIAIKRVKIKAKVSSDTSVPLHVKKDLIGNILKDSDGKALPTDYVNTANNHHVAIFVDDEGNWHEHVVSFYEATASALLGLPIVDKNYKSEEGWKFLFSMKQNEYFVFPNEKTGFVPSEIDLTDPKNYSLISPHLYRVQKFSSLFYIFRHHLETNVEEPNELRDMTWKSIRSVKNLNGAIKVRVNHIGSIVAVGEY

SEQ ID NO: 7972 - protein, 1398 aa, unidentified
  REGION 1..1398: note = Description of Unknown:uncultivated organism sequence
MKKILGLDLGTTSIGWALVNEKESESEQSSIIRLGVRVNPLTVDEKSNFEKGKSITTNSDRRMKRSMHRNLQRYKLRRKNLIECLIEHHIINKDTPLFELGNGITFKTYRARAKAVTEEISLEDFARVLLMINKKRGYKSSRKVKDNEEGELIDGMEIAKRLYDENLTPGQLLLELHEKGKRTRPVFYRSDLQAELDKIWKIQSTYYPNILTDDFKTSIRGFNKTQTSGAFYGAYKIYTAKNSGKEGYIQSLKWRTEALSHKIGIEEVAYILADINGAINNSSKRLAMISDRSKELYFSRQTIGQYLMQHLDENPNASLTNIIFYRQDYMDEFEAIWEKQAQYHPELTAELKKEIRDIIIFYQRDLKSCKNLVSYCELEHQEREVVIDGKKKMIFTGCKVCPKSSPLYQDFKIWQILNNLQVSVIGYQKKKIKKEASQLSLFDDIETGSLNRFLSQEEKDILYHELSIKEKMGKKDVLKLLFDNPKDLDLNYKEVEGNRTIALLFKAFQDIISMTGNGEYDFSKMPTDDALSITTEIFRGLGYKTDYLTFDSLLEGKALEQQPSYRLWHLLYSYTGDKSTTGNVALLERIKDICGFEKEYANILANVSLPLDYGSLSAKAIRKILPHMMKGYEYSEACRKAGYNHSARSLTKEELATKNYKTHLDEIKRNSLRNPVVEKILNQMINVINEVVTTYGKPDEIRIEMARELKKSQEERQLLEEAIRKNTTESEKLRQELETEFDIQHVTRNDILRYKLYNELKLNGYKTLYSNTYIPREELFSKRFDIEHIIPKARLFDDSFSNKTLEVRDINIEKGNMTAFDYVAGKYDEKYLSDYESRIEELYSQKVISRTKRNNLLMKESEIPSDFLERDLRDSQYIARKAREILEEMVPHVVTTTGAVTSRLREDWQLVNLMQELNWDKYENLGMTERYTDKNGNIVKRIKDWTKRNDHRHHAMDALTIAFTKRSIVQYLSNLNARSDKSKSIYGIEQKELHRDEKDHKLVFNAPMPLNEFRAEAKKHLESILVSIKAKNKVVTKNINRFKNKEGQQQKIQLTPRGALHNETVYGKIQNYEAEYRKVDGKFTEEVILRVSNQKYRHALLERLAAFGNDPKKAFTGKNSLEKNPIWLNANHSHCVPAKVKLYKIVDVFTIKKAVDKDLKIDKVIDGRIRQILQERLNEFGGDASKAFSNLDENPIWLNQEKGISIKRVKIRAKVSSDTSVPLHIKKDMYGNIMKNKDGQPIPIDYVNTANNHHVAIFIDEDGNWHEHVVSFYEATASALLGLPIVDKDYKREEGWKFLFSMKQNEYFVFPNEKSGFVPSEIDLTAPENYHLISPNLYRVQKFSSSFYVFRHHLETNVDESNELKDLTWKRITSIKNLEGIVKVRVNHIGQIVTVGEY

SEQ ID NO: 7973 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLVECLLAHHIIKDDTPLFELGNNTTFQTYRARAKAVTEEISLEDFARVLLMINKKRGYKSSRKVKDGEEGELIDGMEIAKRLYDENLTPGQLLLDLHNKGKRNRPTFYRSDLQAEFDKIWEFQSTFYPNILTDEFKSSIHGFNKSQTSGAFYGVHQISTARNNGKEGYVQALMWRTEALKRQLGIEEIAYTLADINGAINNSSKRLAMISDRSKELYFNHLTIGQYLMQLLNENPNHSLTNIIFYRQDYMDEFEAIWEKQAQYHPELTLELKKEIRDIIIFYQRDLKSCKNLVGYCELEHSEREITIDGKTKTILMGCKVCPKSSFLFQDFKIWQMLNNLQVSVVGRQRKKIKKDKTQPSLFDDVETGALNRFLTQEEKDILYNELSIKEKMSKREVLKLLFDNSNSLDLNYKEIEGNRTMATLFKAYQDIISLTGNGEYDFAKMSSKEVLTITTEIFKGLGYKTDYLTFNPLLEGKSLEKQPSYRLWHLLYSYTGDKSATGNEALMKKIQELCGFEKEYATILANISLALDYGSLSAKAIRKILPYMMKGYEYSEACSLAGYKHSARSLTKDELVNKEYKSHLDEIRRNSLRNPVVEKILNQMINVINEIIKTYGKPDEIRIEMARELKKSKEERELLDAAIRKNTAESEKLRKELEEEFGIQHVTKNDILRYKLYNELKMNGYKTLYSNTYIPREELFSKRFDIEHIIPQSRLFDDSFSNKTLEVRDINIEKGNKTAYDYVAEKYDEQGIVDYESRVEELFSNNAISRTKRNNLLMKEADIPSDFLNRDLRDSQYIARKAREILEELVPFVVTTTGSVTSRLREDWQLVNIMQELNWDKYDALGLTEHYTDKNGNIVKRIKDWTKRNDHRHHAMDALTIAFTKRGIVQYLSNMNARSDKSGSIYGIEQKELHRNEKDHKLVFNAPMPLDEFRAEAKKHLKSILVSIKAKNKVVTKNINRAKMKDGRQQKIQLTPRGALHNETVYGKIRNYEAEYRKVDGKFTEDVILRVCNQRQREALLSRLTEYDNDPKKAFTGKNSLEKNPIWLKADHSYAVPLKVKLYKIVDVFTIKKAVDKDLKIDKVIDLKIRSILQARLNEYNGDASKAFANLDENPIWLNQEKGIAIKRVKIRAKVSSETSVPLHVKKDLLGNILKSSDGIALPTDYVNTASNHHVAIFIDAEGNWHEHVVSFYEATASAMLGLPIIDKNFKSEEGWKFLFSMKQNEYFVFPNEKTGFVPTEIDLTDPKNYAQISPNLYRVQKFSSSFYVFRNHLETNVEEIKEQKGMSWFWVTSIKKLQGAVKVRINHLGNIVSIGEY

SEQ ID NO: 7974 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKSNFERGKSITTNADRRLKRSMHRNLQRYKLRRKNLIECLLEHHIITDDTPLFEHGNNTTFQTYRARAKAVTEEITLEEFARVLLMINKKRGYKSSRKVKDGEEGELIDGMEIAKRLYEENITPGRLLLDLYMNGKKNRPTFYRSDLQAEFDKIWEVQSAFYPEILTDDFKSSLRGFNRTQTSVAFYGVHKITTAQNNGKDKYLQSLAWRNDALYQKIDIEEVAYALADINGAINNSSKRLAMISDRSKELYFNHQTIGQYLMQRLDANPNNSLTNIIFYRQDYMDEFEAIWERQAQYHPELTPELKKEIRDIIIFYQRDLKSCKNLVSYCELEHTEREITIDGKKKTIQTGCKVCPKSSPLFQDFKIWQILNNLQVSVVGHKRKRIKKDKSQLSLFDDAETGALNRFLTQEEKDILYNELSIKDKMSKKDVLKLLFDNPKDLDLNYIEVEGNRTMATLFKAYQDIISLTGNGEYDFSKMPADEARSITSEIFTGLGYKTDFLSFNPLFEGKALEQQPAYRLWHLLYSYTGDKSVTGNEALLAKIQELCGFEKEYATILSNVSLALDYGSLSAKAIRKILPHMMKGYEYSEACKMAGYNHSARSLTKEELANKEYKSRLDIIKRNSLRNPVVEKILNQMINVINEIIKTYGKPDEIRIEMARELKKSQEERELLDAAIRKNTAESEKLRKELEEEFGIQHVTRNDILRYKLYNELKLNGYKTLYSNTYIPREELFSKRFDIEHIIPQSRLFDDSFSNKTLEVRDINIEKGNMTAYDYVAGKYDEKYLIDYESRVEELFAQKVISRTKRNNLLMKEEDIPSDFLERDLRDSQYIARKSREILEELVSFVVTTTGAVTSRLREDWQLVNIMQESNWNKYDALGLTEHYTDKNGNIVKRIKDWTKRNDHRHHAMDALTIAFTKRSIVQYLSNMNARSDKSSSIYGIEQKELHRDEKNHNLVFNAPMPLNEFRAEAKKHLESILVSIKAKNKVVTKNINKGKTKDGHQQIVQLTPRGALHNETVYGKIRNYEAEYRKVDGKFTEEVILRVSNQKCREALLNRLAEYDNNPKKAFTGKNSLEKNPIWLNADHSHAVPLKVKLYKIVDVFTIKKAVDKDLKIDKVIDNKIRAILQQRLDEFVGDAAKAFSNLDENPIWLNEEKGIAIKRVKIRGIANGEPIRVKRDIKGNIIKDENGNPIPNDYVNTGNNHHVAVFRDKEGKLQEHVVSFYEATTRAILGYPIVDKEYRHSEGWEFLFSMKQNEYFVFPNEKTGFKPQEIDLLNANNWGIISPNLYRVQKFTTGDYFFRHHLETNVESDNALRDITWKRIRSIQDLDGIVKVRLNHLGSIVTVGEY

SEQ ID NO: 7975 - protein, 1395 aa, unidentified
  REGION 1..1395: note = Description of Unknown:uncultivated organism sequence
MKKILGLDLGTTSIGWALVNEKENNNEDSSIIRLGVRVNPLTVDEKANFEKGKAITTNADRRMKRGMHRNLQRYKLRRSNLIECLMEHHIISDDTPLFEFGNKSTFDTYRARAKAVDEEISLDEFARVLLMINKKRGYKSNRKVKDTDEGELIDGMEVAKRLYHEQLTPGQLLLDLLLKGKKNRPSFYRSDLQSEFNRIWEVQSAFYPEILTEDLKNHVRGFNKTQTSGAFYNLCKVSTAKNSGKEGYAQALKWRCKALTEQLPIDEVAYVLCDINGAINNSSKRLAMISDRSKSLYFNHQTVGQYLMQRIENNPNDSLKNIVFYRQDYLDEFEAIWEKQAQFHPELTPELKKEIRDIVIFYQRDLKSCKNLISYCEFEHSEKEVMIEGKAKTITTGCKVCPKSSPLYQDFKIWQILNNLQVSVIGYTRKKQKKNDAQLSLFAEDEVDSLQRFLNQEEKDILYKELSFREKMSKKEILKLLFDNPQSLDLNYKEVEGNRTMAALYKAYQEIISLTGNGEYDFSKKTADEVVALTTEIFSGLGYNTSILTFNPLLKGKDLEQQPLFKLWHLLYSYAGDNSVSGNEALLRRIEKLCGFEKEYAAVLAGVVFPLDYGSLSAKAIRKILPFMMKGYEYSKACEMAGYHHSARSLTKEQLNDKEYKSQLDEIKRNSLRNPVVEKILNQMINVVNEVVTTYGKPDEIRIELARELKKSQAEREQLDEAIRRNTAQSEKCRKELEEEFGIQHVTRNDILRYQLYNELKMNGYKTLYSNTYIPKEELFSKHFDIEHIIPKARLFDDSFSNKTLEARDVNIEKGDMTAYDYVASKYDEKGLADYESRVEELFAKNAISRTKRNNLLMKEPDIPSDFLQRDLRDSQYIAKKAREILEQMVPFVVTTTGSVTSRLRDDWQLVNVMQELNWDKYHALGLTESYTDHNGNTVYRIKDWTKRNDHRHHAMDALTIAFTKRSIVQYLSNMNARSDKGSSIYGIERNELHRDEKSHKLLFNPPMPLEVFRAEAKKHLENILVSIKAKNKVVTKNINRAKTKGGHQQKVQLTPRGALHNETVYGKIHNFEAEYKKVDGKFNEETILRVSNMKYREALMKRLALFGNDAKKAFTGKNTLEKNPIWLDEAHSHCVPQKVKLFKIIDVFTIRKAIDKDLKVDKVIDKKVRVILQQRLDEFGGDAAKAFSNLDDNPIWLNKEKGISIKRVKIRGIANGEPIRYKRNVIGEIMKDDRGLPIPNDYVNTANNHHVAVYRDADGKLQENVVSFYEATARAIMGFPIVDKDFKQSEGWTFLFSMKQNEYFVFPNPKTGFVPSEINLMDPNNYRLISPNLYRVQKFSDGDFFFRHHLETNVDQENALKDVTWKRITAIKNLEGVVKVRVNHIGQIVSVGEY

SEQ ID NO: 7976 - protein, 1398 aa, unidentified
  REGION 1..1398: note = Description of Unknown:uncultivated organism sequence
MKKILGLDLGTTSIGWALVNEKENNNEDSSIIRLGVRVNPLTVDEKANFEKGKAITTNADRRMKRGMHRNLQRYKLRRSNLIECLMEHHIISDDTPLFEFGNKSTFDTYRARAKAVDEEISLDEFARVLLMINKKRGYKSNRKVKDTDEGELIDGMEVAKRLYHEHLTPGQLLLDLLLKGKKNRPSFYRSDLQSEFNRIWEVQSAFYPEILTEDLKNHVRGFNKTQTSGAFYNLCKVSTAKNSGKEGYAQALKWRCKALTEQLPIDEVAYVLCDINGAINNSSKRLAMISDRSKSLYFNHQTVGQYLMQRIENNPNDSLKNIVFYRQDYLDEFEAIWEKQAQFHPELTPELKKEIRDIVIFYQRDLKSCKNLISYCEFEHSEKEVMIEGKAKTITTGCKVCPKSSPLYQDFKIWQILNNLQVSVIGYTRKKQKKNDAQLSLFAEDEVDSLQRFLNQEEKDILYKELSFREKMSKKEILKLLFDNPQSLDLNYKEVEGNRTMAALYKAYQEIISLTGNGEYDFSKKTADEVVALTTEIFSGLGYNTSILTFNPLLKGKDLEQQPLFKLWHLLYSYAGDNSVSGNEALLRRIEKLCGFEKEYAAVLAGVVFPLDYGSLSAKAIRKILPFMMKGYEYSKACEMAGYHHSARSLTKEQLNDKEYKSQLDEIKRNSLRNPVVEKILNQMINVVNEVVTTYGKPDEIRIELARELKKSQAEREQLDEAIRRNTAQSEKCRKELEEEFGIQHVTRNDILRYQLYNELKMNGYKTLYSNTYIPKEELFSKHFDIEHIIPKARLFDDSFSNKTLEARDVNIEKGDMTAYDYVASKYDEKGLTDYESRVEELFAKNAISRTKRNNLLMKEPDIPSDFLQRDLRDSQYIAKKAREILEQMVPFVVTTTGSVTSRLRDDWQLVNVMQELNWDKYHALGLTESYTDHNGNTVYRIKDWTKRNDHRHHAMDALTIAFTKRSIVQYLSNMNARSDKGSSIYGIERNELHRDEKSHKLLFNPPMPLEVFRAEAKKHLENILVSIKAKNKVVTKNINRAKTKSGHQQKVQLTPRGALHNETVYGKIHNFEAEYKKVDGKFNEETILRVSNMKYREALMKRLALFGNNAKKAFTGKNTLEKNPIWLDEAHSHCVPQKVKLFKIIDVFTIRKAIDKDLKVDKVIDKKVRVILQQRLDEFGGDAAKAFSNLDDNPIWLNKEKGISIKRVKIRAKVSSDTSVPLHVKTDLWGHMMKDQYGKSIPTDYVNTASNHHVAIFVDANGDWHEHVVSFFEAATNALLGLPIVDKDYKKEEGWKFLFSMKQNECFVFPNPKTGFVPSEINLMDLNNYRLISPNLYRVQKFSSLFYVFRHHLETNVEEPKELRDVTWKSIRSVKNLEGIVKVRINHIGQIVSVGEY

SEQ ID NO: 7977 - protein, 1399 aa, unidentified
  REGION 1..1399: note = Description of Unknown:uncultivated organism sequence
MKRILGLDLGTTSIGWALVNEKENDNEQSSIIKLGVRVNPLTVDEKTNYEKGKSITTNADRRLKRSMHRNLQRYKLRRANLIDCLKRNGIITDETSLFELGNRTTFNTYRSRAKAVEEEISLDELARVLLMINKKRGYKSNRKIKESDEGELVDSIDIAKRLYDENLTPGQLLLELYKQGKKSRPTFYRSDLQAEFDKIWEVQSAFYPEILTQDFKDHIRGFGKTQTSGAFYGEYQITTAKNNGKESYSQALKWRTNALLDKKLDIEELAYVLCDINGAINNSSKRLAMISDRSKELYFNHLTVGQFLMKIIERNNNASLKNIIFYRQDYLDEFETIWEKQKQYHPELTASLKKEIRDIIIFYQRDLKSCKNLINFCEFEHSEKEVIIEGKKRIVTVGCKVCPKSSPLFQNFKIWQTLNNLQVSVLRHQRKKIVKDDSQLSLFDNNEGEPLQRFLDQEEKDILFKELSIKEKMSKKDILKLLFENSSKLDLNYKEVEGNKTIAALFKAYQDIISLTGNGEYDFSKMPADNVLSITTEIFSGLGYKTDFLTFNPLLPHKELERQPLYRLWHLLYSYAGDNSMSGNEALYKKLQELCGFEKEYAVILSNISLPIDYSSISAKAIRKILPFMMKGYEYSTACEKAGYNHSTRSLTKEELKNKEYKSKLDEIKRNSLRNPVVEKILNQMINVVNEISATYGKPDEIRIELARELKKSQAERELLDEAIRKNTTEAEKCRKILHDEFKIQHVTKNDILRFKLYEELKLNGYKTLYSNTYIPREELFSKRFDIEHIIPKAKLFDDSFSNKTLEVRDINIEKADLTAYDYVNGKYDEKGVLDYENRVEELYNNKAISKTKRNNLLMKEDEIPSDFLERDLKDSQYIAKKAREILEEMVPFVVTTTGSVTSRLREDWQLVNIMQELNWDKYDALGLTDSYIDRNGNTIRRIKDWTKRNDHRHHAMDALTIAFTKRSIVQYLSNLHARSNKSSSIYGIEQKELNRDNKDHKLVFNPPMPLNEFRAQAKKHLESVLVSIKAKNKVVTKNINRSKTRNGHYQKVQLTPRGALHNETVYGKIKTFEAEYKKVDGKFTEETILRVCNEKYKHALLNRLSLYGNDPKKAFTGKNSLEKNPVWLNDDHSYSVPLKVKLYKVVNVFTIRKAIDKDLKIDKVIDEGIRVILQNRLDQFNGDAVKAFSNLEENPIWLNKEKGIAIKRVKIKAKVSEETSVPLHIKHDLCGEIINDSKGNPIPTDYVNTANNHHVSIFIDNDGNWHEHVVSFYEATTRAILGYPIVDKNYMCEEGWKFLFSMKQNEYFVFPNEQTGFDPLDIDLLDPQNYPLISPNLFRVQKFSSLFYVFRHHLETDVEEPKELKDITWKSIRSVKNLNGIVKVRVNHIGNIVSIGEY

SEQ ID NO: 7978 - protein, 1396 aa, unidentified
  REGION 1..1396: note = Description of Unknown:uncultivated organism sequence
MKKILGLDLGTNSIGWALVNEKENDQEKSSIIKLGVRVNPLTVDEKTNFEKGKSITTNAERRAKRSMHRNLQRYKLRRKNLIDCLIKNGIITKETPLFELGNKSTFQTYRARAKAVTEEVSLEDFARILLMINKKRGYKSNRKIKDNEEGELVDGMEIAKRLYHEHLTPGQLLHSLFCKGKKIKPAFYRSDLHDEFNLIWEKQKKFYPEILTTDFKKALFGLNKALTSSAFYKTYKINTAKNSGKDKLAQALKWRVDALSKDIGIEELAYVLSDINGAINSSSKRLAMISDRSKELYFSQQTVGQYLLKRLDENPNSSLTNIIFYRQDYLDEFEAIWEKQAEFHTELTKELKKEIRDIIIFYQRDLKSCKNLINYCELEHEEKEVVVEGKKKFIIIGNKVCPKSSPLFQDFKVWQTINNIQVSTLGHQRKKIKKNSSQMSLSNESESSSLQRFLDQEEKNILYKELCIKEKMSKKDILVLLFDNPHKLDLNYKEVEGNKTIATIYKALQEIISLTGHGEYDFSKMRYDNVYFLTESIFSGLGYKTDFLSFNPLLQGKEMERQPLYQLWHLLYSYAGDSSKTGNEALLKKISDICGFEKEYAIVLSNISLPLDYGSLSAKAIRKILPHMMKGYEYSKACEQAGYKHSARSLTKEELKNKEYKDKLDELRRNSLRNPVVEKILNQMINVVNGIITTYGKPDEIRIELARELKKSQEERLLLDEAIRKNTSDNDKYKDDLEKEFGIQHVTKNDIIRYKLYLELKPNGFKTLYSNTYIPKEELFSKRFDIEHIIPKARLFDDSFSNKTLEARDVNIEKGDMTAYDYVANKNDEKGISDYESRIEELYKQKAISKTKRNNLLMKEEEIPSDFLERDLRDSQYIAKKAREILEGLVPFVVTTTGAVTKRLREDWQLVNIMQELNWDKYNALGLTESYTDKNGNIVRRIKDWTKRNDHRHHAMDALTIAFTNRSIVQYLSNLNARSDKSSSIYGIEQEYLHRDTKSNKLIFNAPIPLDIFRNEAKKHLENVLVSIKAKNKVTTININKTKTKEGFNRKAQLTPRGALHNESIYGKIKNFEAEYKLVDGKFSEETILRVCNKKYRDALLSRLSEFGGDPKKAFTGKNNIEKNPIWMDANHTYQLPSKVKLFKIIDVFTIKKAIDKDLKVDKVIDKKIREILQLRINDYGNADKAFSNLEENPIWLNQEKGIAIKRVKIKAKASSENAIPLHVKKDLFGNIIKKDGHVIPIDYVNTANNHHAAIFIDDKGSWHEHIVSFYEATVNALLGLPIVDKDYKKEEGWHFLFSMKQNEYFVFPNEKTGFMPSEIDLLNPDNYSLISPNLYRVQKFSSLFYVFRHHLETNVDEPKELRDTTWKSIRSIKNFEGVVKVRVNHLGLIVAIGEY

SEQ ID NO: 7979 - protein, 1395 aa, unidentified
  REGION 1..1395: note = Description of Unknown:uncultivated organism sequence
MKKILGLDLGTTSIGWALVNEKENDDEKSSIIQLGVRVNPLTVDEKANFEKGKSITTNADRRMKRSMHRNLQRYKLRRKNLIECLKEHNIITGETPLFEQGNHSTFKTYRARAKAVEEKISLEDLSRVLLMINKKRGYKSNRKIKDTEEGELVDGMEIAKRLYDENLTPGQLLLDLLQQGKKYRPAFYRSDLQAEFNKIWEVQSAYYPEVLTDDFKKHVSGFNKNQTSGAFYAIHKISTAKNSGKEGYQQALLWRVAALTKKLDIEEVAYVLCDINGAINNSSKRLAMISDRSKELYFSHQTVGQYLMHSIEQNPNASLKNIIFYRQDYLDEFEAIWEKQAQFHPVLTPELKKEIRDIVIFYQRDLKSSKNLINYCEFEHTEREVVVDGKKKTIVTGCKVCPKSSPLFQDFKIWQILNNLQVSVVGHRRKRIKKDELQLSLFADKEGEPLQRFLDQEEKDILFKELSIRDKMSKKEVLKLLFDNPQKLDLNYKEVEGNKTNAALFKAYQDIISLTGNGEYDFTKMPADDVMSITSEIFTGLGYKTDYLTFNPLLEGKALERQPAYRLWHLLYSYTGDNSTTGVEALLKKIQEICGVEKEYATILANVSMPLDYGSLSAKAIRKILPFMMKGYEYSKACELAGYRHSARSLTKEELDNKTYKSHLDELKRNSLRNPVVEKILNQMINVVNEIAATYGKPDEIRIELARDLKKSQEERELLDQAIRKNTAESEKLRKELEEEFGIQHVTKNDILRYKLYNELKMNGYKTLYSNTYIPREDLFSKRFDIEHIIPKARLFDDSFSNKTIEVRDVNIEKGDMTAYDYVAGKYDEKGLADYESRVEELFAQKIISRTKRNNLLMKEADIPSDFLQRDLRDSQYIARKAREILEEMVPFVVTTTGSVTSRLREDWQLVNLMQELNWEKYDTLGLTESYTDKNGNIVRHIKDWTKRNDHRHHAMDALTIAFTKRSIVQYLSNLNARSDKSSSIYGIEQNELNRDNKDRRLVFNAPMPLDEFRAEARKHLESILVSIKAKNKVVTKNINKAKKRDGRQHKIQLTPRGALHNETVYGKITNFEAEYKKVDGKFTEDVILRVSNQRYREALLKRLADFGGDSKKAFTGRNSLDKNPIWLNADHSYCVPSKVKLYKKIDVFTIKKAVDKDLKIEKVIDNKVRAILQQRLNEFGGDAAKAFSNLDDNPIWLNKEKGIAIKRVKIRGIANGEPVRYKRNIKGELMKDENGNPIPNDYVNTANNHHVAVFRDAEGKMQEHVVSFYEATTRAIMGYPVVDREFKRSEGWQFLFSMKQNEYFVFPNEKTGFNPQEIDLLDADNYATISPNLYRVQKFTDGDYFFRHHLETNVENESSLKGIAWKRINSVQSLNGVVKVRVNHIGKIVSVGEY

SEQ ID NO: 7980 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKSNFERGKSITTNADRRMKRSMHRNLQRYKLRRKNLIECLLKHHIISDETPLFEQGNNTTFQTYRARAKAVTEEISLEEFARVLLMINKKRGYKSSRKVKDGEEGELIDGMEIAKRLYEENLTPGQLLLDLYNKGKKNRPTFYRSDLQAEFDKIWEVQSAFYPSILTDDFKSSIHGFNKTQTSGAFYGVHQIYTAKNSGKEGYLQSLTWRTEALKHQLDIEEVAYALADINGAINNSSKRLAMISDRSKELYFNHQTIGQYLMQRLDENPNNSLTNIIFYRQDYMDEFEAIWEKQAQYHSELTPELKKEIRDIIIFYQRDLKSCKNLVSYCELEHTEREIIIDGKKKTILTGCKVCPKSSPLFQDFKIWQILNNLQVSVVGHQRKRIKKDKSQPSLFDDAETGALNRFLTQEEKDILYNELSIRDKMNKRDVLKLLFDNPKNLDLNYKEVEGNRTMAALFKAYQDIISLTGNGEYDFSKMPADEAKSIITEIFKGLGYKTDFLSFNPLLEGKALEQQPAYRLWHLLYSYTGDKSVTGNEALLAKIQELCGFEKEYATILSNVSLALDYGSLSAKAIRKILPHMIKGYEYSEACKMAGYNHSARSLTKEELANKEYKSRLDVIKRNSLRNPVVEKILNQMINVINEIIKTYGKPDEIRIEMARELKKSQEERELLDAAIRKNTTESEKLRKELEEEFGIQHVTRNDILRYKLYNELKLNGYKTLYSNTYIPREELFSKRFDIEHIIPQSRLFDDSFSNKTLEVRDINIEKGNMTAYDYVAGKYDEKYLVDYESRVEELFAQKVISRTKRNNLLMKEEDIPSDFLERDLRDSQYIARKAREILEELVPFVVTTTGAVTSRLREDWQLVNLMQELNWDKYDALGLTEQYTDKNGNIVKRIKDWTKRNDHRHHAMDALTIAFTKRSIVQYLSNMNARSDKSSSIYGIEQKELHRDEKDHNLVFNAPMPLNEFRAEAKKHLESILVSIKAKNKVVTKNINKGKTKDGHQQKVQLTPRGALHNETVYGKIRNYEAEYRKVDGKFTEEVILRVSIQKCREALLKRLAEYDNDPKKAFTGKNSLEKNPIWLNADHSHAIPLKVKLYKIVDVFTIKKAVDKDLKIDKVIDNKIRSILQQRLDEFGGDAAKAFSNLDENPIWLNREKGIAIKRVKIRAKVSSDTSVPLHVKRDLLGNILKDAEGKALPTDFVNTANNHHVAIFIDSEGCWHEHVVSFFEATASALLGLPIVDKDYKREEGWKFLFSMKQNEYFVLPNEKTGFIPSEIDLMDPKNYALISPNLYRVQKFSSSFYVFRHHLETNVDESNELKETTWKRIQTIKYLDGIVKVRLNHLGNIVAIGEY

SEQ ID NO: 7981 - protein, 1394 aa, unidentified
  REGION 1..1394: note = Description of Unknown:uncultivated organism sequence
MKRILGLDLGTTSIGWALVNEKESDNEQSSIVRLGVRVNPLTVDEKSNFEKGKSITTNADRRMKRSMHRNLQRYKLRRKNLIECLIENGIISEDTPLFELGNKSTFNTYKARAKAVEEEISLEDFARVLLMINKKRGYKSSRKIKETEEGELVDGMEIAKKLYQEDITPGQLLLELYQQGKKNRPAFYRSDLQAEFDKIWDVQSKFYPAILSQEFKKTVTGLNKTQTSATFYSIKSISTTKNSGKEAYAQALRWRTEALSKQLDIEEVGYVLADINGAINNSSKRLAMISDRSKELYFNHLTVGQYLMKSLELNPHTSLKNIIFYRQDYLDEFETIWEKQAQFHHELTPELKKDIRDIVIFYQRNLKSCKNLVSYCELEHQEKEVVIDGKKKVIFIGCKVCPKSSPLFQDFKIWQVLNNLEVSVAEHKPKKAKEQSQASLFGSAEMGSLRRFLEQEEKEKLFKELSVKDKMNKKEILKLLFDNPQSLDLNYKEVEGNRTNAAFIKAYQDIISFTGNGEYDFSKMKADDIFALITGIFQGLGYRTDFLTFNPLLNGKDFEQQPYYRLWHLLYSYAGDNSTTGNEALIKKIGEICGFEKEYANILANIALPLDYGSLSAKAIRKILPHMMDGYEYSKACELAGYRHSARSLTKQELDAKAYKDHLDILKRNSLRNPVVEKILNQMINVVNEIIDTYGKPDEIRIELARELKKSQEERALLDEAIRKTTADSEKYRKELETEFGIQHVTKNDILRYRLYLELKPVGFKTPYSNTYIPREELFSKRFDIEHIIPKARLFDDSFSNKTLEVRDVNIEKGNMTAIDFVSGKYDEQGVAEYESRVEELYAHKAISRTKRNKLLMKEADIPADFLERDLRDSQYIAKKAREILEGIVPFVVTTTGTVTSRLREDWQLVNLMQELNWNKYAALGLTESYTDKNGNVVRHIKDWTKRNDHRHHAMDALTIAFTKRSIVQYLSNLNARSDKGSSIYGIEQKELHRDEKGHKLVFNAPMPLDEFRAEARKHLESILVSIKAKNKVMTKNINRAKKKNGHQEKVQLTPRGALHNETVYGKIKNYEAEYRKVDGKFSEETILRVCNLKYRNALLKRLSEFNNDPKKAFTGKNSLEKNPLWLNEDHSHCVPTKVKLYRIVDVFTIKKAVDKDLKIDKVIDKKIRERLQARLDEFNGDAAKAFANLDENPIWLNQEKGIAVKRVKIRGIANGEPIRIKRDVRGNSIKDANGNTIPNDYVNTANNHHVAVFRDAAGNLQEHVVSFYEATTRAIMGYPIVDKDYNSDEGWKFLFSMKQNEYFVFPNPKTGFNPQEIDLLDEKNMPLVSPNLYRVQKFTTGDYVFRHHLETNVESDNVLRDVTWKRIRSIKELESIVKVRVNHIGIIVAVGEY

SEQ ID NO: 7982 - protein, 1393 aa, unidentified
  REGION 1..1393: note = Description of Unknown:uncultivated organism sequence
MKKILGLDLGTTSIGWALVNEKEKDNEKSSIIRLGVRVNPLTVDEKSNFEKGKSITTNADRRMKRSMHRNLQRYKLRRQHLIECLKEHGIINDTTPLFELGNHSTFKTYRARAKAVDEEISLEEFARVLLMINKKRGYKSNRKIKDTEEGELVDGMEIAKRLYDENLTPGQLLLDLYQKGKKTRPAFYRSDLQAEFDRIWEVQSVFYPEILNNDFKKHISGFNKTQTSGAFYAIYSISTTKNSGKEAYAQSLRWRCDALKDQLNIETVAYVLCDINGAINNSSKRLAMISDRSKELYFNHQTVGQYLVQCIDHNPNASLKNIIFYRQDYLDEFETIWERQAQYHQELTPELKKEVRDIIIFYQRNLKSCKNLINYCEFEHTEKEILVEGKKKTIMIGCKVCPKSSPLFQCFKIWQVLNNLQVSVVGHQRKRIKKDDFQLALFADTEGEPLQRFLDQEEKDILFKELTIRDKMSKKEILKLLFDNPQKLDLNYKEVEGNNTMATIIKACQEIISLTGNGDFNFSKMPADDVLAVTTEIFSGLGYKTDFLTFNPLLEGKAMEEQPFYQLWHLLYSYAGDNSISGNEALIKKIHDLCGFEKEYATVLANVSMPLDYGNLSAKAIRKILPFMMKGYEYSKACELAGYRHSARSLTRDELSKREYTSHLSELKRNSLRNPVVEKILNQMINVVNEIVATYGKPDEIRIELARELKNSKEEREQMDIAIRKNTADSEKYRKILEEEFGIQHATRNDIIRYKLYNELKQNGYKTLYSNTYIPREELFSKRFDIEHIIPKARIFDDSFSNKTLEVRDINIEKGDMTAYDFVAGKYDEKGVLDYEKRVEELVTNNAISKTKRNNLLMKEADIPSDFLQRDLRDSQYIAKKAREILEQMVPFVVTTTGSITKRLREDWQLVGVMQELNWQKYDSLGLTETYFDKNGNVVRHIKNWTKRNDHRHHAMDALTIAFTKRSIVQYLNNMNARSDKSSSIYGIEQKELNRDNKDHKLVFNAPMPLNEFRAEAKKHLDSILVSIKAKNKVVTKNINRAKTKDGHQHKIQLTPRGALHNETVYGKIKNFEAEYRKVDGKFTEDTVFRVSNRRYREALAQRLAAFGNDPKKAFTGKNSLEKNPIWLNADHSYSVPLKVKLYKIVDVFTIKKAVDKDLKIDKVIDGRIRELLQQRLNEFNGDAAKAFSNLDDNPIWLNKEKGIAIKRVKIRGIASGEPIRVKRDAKGGIMNDEHGNPIPNDYVNTANNHHVAVFRDASGNLHERVVSFYEATTRAMMGYPIIDKDYKQAEGWQFLFSMKQNEYFVFPSDGFNPSEIDLTDPQNYSLISPNLYRVQKFSEGDYFFRHHLETTVETDNSLKNITWKRINSVKSLEGIVKVRVDHIGRIVSVGEY

SEQ ID NO: 7983 - protein, 1395 aa, unidentified
  REGION 1..1395: note = Description of Unknown:uncultivated organism sequence
MKKILGLDLGTTSIGWALVNEKENDDEKSSIIQLGVRVNPLTVDEKANFEKGKSITTNANRRMKRSMHRNLQRYKLRRKNLIECLKEHNIITGETPLFEQGNHSTFKTYRARAKAVEEEISLEDLSRVLLMINKKRGYKSNRKIKDTEEGELIDGMEIAKRLYDENLTPGQLLLDLLQQGKKYRPTFYRSDLQAEFNKIWEVQSAYYPEVLTDDFKKHVSGFNKTQTSGAFYAIHKISTAKNSGKEGYQQALLWRVAALTKKLDIEEMAYVLCDINGAINNSSKRLAMISDRSKELYFSHQTVGQYLMHSIEQNPNASLKNIIFYRQDYLDEFEAIWEKQAQFHPVLTPELKKEIRDIVIFYQRDLKSSKNLINYCEFEHTEREVVVDGKKKTIVTGCKVCPKSSPLFQDFKIWQILNNLQVSVVGHRRKRIKKDELQLSLFADKEGEPLQRFLDQEEKDILFKELSIRDKMSKKEVLKLLFDNPQKLDLNYKEVEGNKTNAALFKAYQDIISLTGNGEYDFTKMPADDVMSITSEIFTGLGYKTDYLTFNPLLEGKALERQPAYRLWHLLYSYTGDNSTTGVEALLKKIQEICGFEKEYATILAKVSLPLDYRSLSAKAIRKILPFMMKGYEYSKACELAGYRHSARSLTKEELDNKTYKSHLNELKRNSLRNPVVEKILNQMINVVNEIAATYGKPDEIRIELARDLKKSQEERELLDQAIRKNTAESEKLRKELEEEFGIQHVTKNDILRYKLYNELKMNGYKTLYSNTYIPREDLFSKRFDIEHIIPKARLFDDSFSNKTIEVRDVNIEKGDMTAYDYVAGKYDEKGLADYESRVEELFAQKIISRTKLNNLLMKEADIPSDFLQRDLRDSQYIAKKAREILEDMVPFVVTTTGSVTSRLREDWQLVNLMQELNWEKYDTLGLTESYTDKNGNIVRRIKDWTKRNDHRHHAMDALTIAFTKRSIVQYLSNLNARSDKSGSIYGIEQNELNRNNKDHRLVFNAPMPLDEFRAEARKHLESILVSIKAKNKVVTKNINKAKKRDGRQHKIQLTPRGALHNETVYGKITNFEAEYKKVDGKFTEDVILRVSNQRYREALLKRLADFGGDSKKAFTGRNSLDKNPIWLNADHSYCVPSKVKLYKKIDVFTIKKAVDKDLKIEKVIDNKVRAILQQRLNEFGGDAAKAFSNLDDNPIWLNKEKGIAIKRVKIRGIANGEPVRYKRNIKGELMKDENGNPIPNDYVNTANNHHVAVFRDAEGKMQEHVVSFYEATTRAIMGYPVVDREFKRSEGWQFLFSMKQNEYFVFPNEKTGFNPQEIDLLDADNYATISPNLYRVQKFTDGDYFFRHHLETNVENESSLKGITWKRINSVQSLNGVVKVRVNHIGKIVSVGEY

SEQ ID NO: 7984 - protein, 1395 aa, unidentified
  REGION 1..1395: note = Description of Unknown:uncultivated organism sequence
MKKILGLDLGTTSIGWALVNEKENDDEKSSIIQLGVRVNPLTVDEKANFEKGKSITTNADRRMKRSMHRNLQRYKLRRKNLIECLKEHNIITGETPLFEQGNHSTFKTYRARAKAVEEEISLEDLSRVLLMINKKRGYKSNRKIKDTEEGELVDGMEIAKRLYDENLTPGQLLLDLLQQGKKYRPAFYRSDLQAEFNKIWEVQSAYYPEVLTDDFKKHVSGFNKTQTSGAFYAIHKISTAKNIGKEGYQQALLWRVAALTKKLDIEEVAYVLCDINGAINNSSKRLAMISDRSKELYFSHQTVGQYLMHSIEQNPNASLKNIIFYRQDYLDEFEAIWEKQAQFHPVLTPELKKEIRDIVIFYQRDLKSSKNLINYCEFEHTEREVVVDGKKKTIVTGCKVCPKSSPLFQDFKIWQILNNLQVSVVGHRRKRIKKDELQLSLFADKEGEPLQRFLDQEEKDILFKELSIRDKMSKKEVLKLLFDNPQKLDLNYKEVEGNKTNAALFKAYQDIISQTGNGEYDFTKMPADDVMSITSEIFTGLGYKTDYLTFNPLLEGKALERQPAYRLWHLLYSYTGDNSTTGVEALLKKIQEICGFEKEYATILANVSMPLDYGSLSAKAIRKILPFMMKGYEYSKACELAGYRHSARSLTKEELDNKTYKSHLDELKRNSLRNPVVEKILNQMINVVNEIAATYGKPDEIRIELARDLKKSQEERELLDQAIRKNTAESEKLRKELEEEFGIQHVTKNDILRYKLYNELKMNGYKTLYSNTYIPREDLFSKRFDIEHIIPKARLFDDSFSNKTIEVRDVNIEKGDMTAYDYVAGKYDEKGLADYESRVEELFAQKIISRTKRNNLLMKEADIPSDFLQRDLRDSQYIAKKAREILEDMVPFVVTTTGSVTSRLREDWQLVNLMQELNWEKYDTLGLTESYTDKNGNIVRRIKDWTKRNDHRHHAMDALTIAFTKRSIVQYLSNLNARSDKSGSIYGIEQNELNRNNKDHRLVFNAPMPLDEFRAEARKHLESILVSIKAKNKVVTKNINKAKKKDGHQQKVQLTPRGALHNETVYGKITNFEAEYKKVDGKFTEDVILRVSNQRYREALLKRLADFGGDSKKAFTGKNSLDKNPIWLNADHSYCVPLKVKLYKKIDVFTIKKAVDKDLKIEKVIDNKVRAILQQRLNEFGGDAAKAFSNLDDNPIWLNKEKGIAIKRVKIRGIANGEPVRYKRNIKGELMKDENGNPIPNDYVNTANNHHVAVFRDAEGKMQEHVVSFYEATTRAIMGYPVVDREFKRSEGWQFLFSMKQNEYFVFPNEKTGFNPQEIDLLDADNYATISPNLYRVQKFTDGDYFFRHHLETNVENESSLKGITWKRINSVQSLNGVVKVRVNHIGKIVSVGEY

SEQ ID NO: 7985 - protein, 1375 aa, unidentified
  REGION 1..1375: note = Description of Unknown:uncultivated organism sequence
MNEKEKDNEKSSIIRLGVRVNPLTVDEKSNFEKGKSITTNADRRMKRSMHRNLQRYKLRRQHLIECLKEHGIINDTTPLFELGNHSTFKTYRARAKAVDEEISLEEFARVLLMINKKRGYKSNRKIKDTEEGELVDGMEIAKRLYDENLTPGQLLLDLYQKGKKTRPAFYRSDLQAEFDRIWEVQSVFYPEILNNDFKKHISGFNKTQTSGAFYAIYSISTTKNSGKEAYAQSLRWRCDALKKQLNIETVAYVLCDINGAINNSSKRLAMISDRSKELYFNHQTVGQYLVQCIDHNPNASLKNIIFYRQDYLDEFETIWERQAQYHQELTPELKKEVRDIIIFYQRNLKSCKNLINYCEFEHTEKEILVEGKKKTIMIGCKVCPKSSPLFQCFKIWQVLNNLQVSVVGHQRKRIKKDDFQLALFADTEGEPLQRFLDQEEKDILFKELTIRDKMSKKEILKLLFDNPQKLDLNYKEVEGNNTMATIIKACQEIISLTGNGDFNFSKMPADDVLAVTTEIFSGLGYKTDFLTFNPLLEGKAMEEQPFYQLWHLLYSYAGDNSISGNEALITKIHDLCGFEKEYATVLANVSMPLDYGNLSAKAIRKILPFMMKGYEYSKACELAGYRHSARSLTRDELSKREYTSHLSELKRNSLRNPVVEKILNQMINVVNEIVATYGKPDEIRIELARELKNSKEEREQMDIAIRKNTADSEKYRKILEEEFGIQHATRNDIIRYKLYNELKQNGYKTLYSNTYIPREELFSKRFDIEHIIPKARIFDDSFSNKTLEVRDINIEKGDMTAYDFVAGKYDEKGVLDYEKRVEELVTNNAISKTKRNNLLMKEADIPSDFLQRDLRDSQYIAKKAREILEQMVPFVVTTTGSITKRLREDWQLVGVMQELNWQKYDSLGLTETYFDKNGNVVRHIKNWTKRNDHRHHAMDALTIAFTKRSIVQYLNNMNARSDKSSSIYGIEQKELNRDNKDHKLVFNAPMPLNEFRAEAKKHLDSILVSIKAKNKVVTKNINRAKTKDGHQHKIQLTPRGALHNETVYGKIKNFEAEYRKVDGKFTEDTVFRVSNRRYREALAQRLAAFGNDPKKAFTGKNSLEKNPIWLNADHSYSVPLKVKLYKIVDVFTIKKAVDKDLKIDKVIDGRIRELLQQRLNEFNGDAAKAFSNLDDNPIWLNKEKGIAIKRVKIRGIASGEPIRVKRDAKGGIMNDEHGNPIPNDYVNTANNHHVAVFRDASGNLHERVVSFYEATTRAMMGYPIIDKDYKQAEGWQFLFSMKQNEYFVFPSDGFNPSEIDLTDPQNYSLISPNLYRVQKFSEGDYFFRHHLETTVETDNALRDITWKRIRSIDGIDGAIKVRVDHIGRIVSVGEY

SEQ ID NO: 7986 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKSNFEKGKSITTNADRRMKRSMHRNLQRYKLRRKNLIECLLEHHIITDETPLFEKGNNTTFQTYRARAKAVTEEISLEDFARVLLMINKKRGYKSSRKVKDGEEGELIDGMEIAKRLYEENITPGQLLLDLYNKGKRNRPTFYRSDLQAEFDKIWAMQSTFYPEILTDDFKSSIRGFNKMQTSGAFYGVHQIYTAKNSGKEGYAQALLWRTEALKHQMDIEEVAYALADINGAINNSSKRLAMISDRSKELYFDHLTIGQYLMKRLDENPNNSLTNISFYRQDYMDEFETIWEKQAQYHPELTQELKKEIRDIIIFYQRDLKSCKNLVSYCELEHTEREITIDGKKKTILTGCKVCPKSSPLFQDFKIWQILNNLQVSVVGRQRKKIKKDKNQLSLFDDVETGALNRFLTQEEKEILYNELSIKEKLSKKDVLKLLFDNHNSLDLNYKEVEGNRTMAALFKAYQDIISLTGNGEYDFSKMPTDEVMNITSEIFKGLGYKTDFLTFNPLLKGKSLEQQPVYRLWHLLYSYTGDKSATGNEALLNRIQELCGFEKEYAVILSNISFALDYSSLSAKAIRKILPHMTKGFEYSEACKMTGYNHSERSLTKEELAQKEYKSHLDEIKRNSLRNPVVEKILNQMINVVNEIIKTYGKPDEIRVEMARELKKNQEERELLDAAIRKNTAESEKLRKELEEEFGIQHVTRNDILRYKLYNELKLNGFKTLYSNTYIPREDLFSKRFDIEHIIPQSRLFDDSFSNKTLEVRDINIEKGNKTAYDYVSEKYDEQGVTDYESRVEELFNNKVISRTKRNNLLMKEADIPSDFLNRDLRDSQYIARKAREILEELVPFVVTTTGAVTSRLREDWQLVNIMQELNWEKYDALGLTEQYTDKNGNIVKRIKDWTKRNDHRHHAMDALTIAFTKRSIVQYLSNMNARSDKSGSIYGIEQKELHRDEKDHKLVFNAPMPLDIFRAEAKKHLECILVSIKAKNKVVTKNINKSKTKNGHQQKVQLTPRGALHNETVYGKIQNYEAEYKKVDGKFTEDVILRVSSQKHREALLKRLAEYGNDPKKAFTGKNSLEKNPIWLNADHSYAVPLKVKLYKIVDVFTIKKAVDKDLKLDKVIDNKVRAILQARLDEFNGDAAKAFSNLDENPIWLNKEKGIAIKRVKIKAKVSSDTSVPLHVKKDLIGNILKDSDGKALPTDYVNTANNHHVAIFVDNDGNWHEHVVSFYEATASALLGLPIVDKNYKSEEGWKFLFSMKQNEYFVFPNEKTGFVPSEIDLTDPKNYSLISPNLYRVQKFSSLFYIFRHHLETNVEEPNELRDMTWKSIRSVKNLNGAIKVRVNHIGSIVAVGEY

SEQ ID NO: 7987 - protein, 1444 aa, unidentified
  REGION 1..1444: note = Description of Unknown:uncultivated organism sequence
MFSQRNNPYCDLLKISGAKIKNFYESTKCFKSFLYFCQQITKNAINMKKILGLDLGTTSIGWALVNEKENDNEKSEIIRLGVRVNPLTIDEKTNYEKGKSITTNADRRLKRSMHRNLQRYKLRRKNLIECLLEHHIISDETPLYEQGNNTTFQTYRARAKAVTEEVTLEDFARVLLMINKKRGYKSSRKVKDGEEGELIDGMEIAKRLYEENLTPGQLLLDLYQKGKKNKPTFYRSDLQAEFDKIWEMQSAFYPDILTDDFKSSVRGFNKTQTSGAFYGVHQISTAKNSGKEGYAQSLLWRTEAIKHQLDIEVVAYALADINGAINNSSKRLAMISDRSKELYFNHQTIGQYLMQRLDENPNNSLTNIIFYRQDYLDEFEAIWEKQAQYHSELTPELKKEIRDIIIFYQRDLKSSKNLVSYCELEHAEREITIEGKKKTMLTGCKVCPKSSPLFQDFKIWQILNNLQVSVVGHQRKRIKKDKLQLSLFDDAETGSLNRFLTQEEKDILYNELSIKDKMSKRDVLKLLFDNPKELDLNYKEVEGNRTMAALFKAYQDIISLTGNGEYEFSKMSTDEVMSITTEIFAGLGYKTVFLTFDSLLEGKALEQQPAYRLWHLLYSYSGDKSVTGNEALLNRIQELCGFEKEYATILANVSLALDYGSLSAKAIRKILPHMMKGYEYSEACKMAGYNHSVRSMTKEELANKEYKSRLDEIRRNSLRNPVVEKILNQMINVINEIIKTYGKPDEIRIEMARELKKSQEERELLEAAIRKNTAESERLRKELEEEFGIQHVTRNDILRYKLYNELKLNGYKTLYSNTYIPREELYSKRFDIEHIIPQSRLFDDSFSNKTLEVRDINIEKGNKTAYDFVAEKYNEQGLADYESRVEELFNNKVISRTKRNNLLMKESEIPSDFLERDLRDSQYIARKAREILEEIVPFVVTTTGAVTSRLREDWQLVNIMQELNWNKYNALGLTERYTDKNGNIVKRIKDWTKRNDHRHHAMDALTIAFTKRSIVQYLSNLNARSDKSSSIYGIEQKELHRDEKDHKLVFNAPMPLDEFRAEAIKHLESILVSIKAKNKVVTKNINKVKTKDGHQQKVQLTPRGTLHNETVYGKIRNYEAEFRKVDGKFTEEVILRVSNQKYREALLKRFAEFDNDPKKAFTGKNSLEKSPIWLNADHSHAVPLKIKLYKIVDVFTIKKAVDKDLKIDKVIDNKVRAILQARLDEFNGDAAKAFSNLDENPIWLNKEKGIAIKRVKIRAKVSSDTSVPLHIKKDLLGNIIEDVEGRPLPTDYVNTANNHHVAIFVDTEGNWHEHVVSFFEATASALLGLPIVDKNYKSEEGWKFLFSMKQNEYFVFPNEKTGFIPSEIDLMDIKNYPLISPNLYRVQKFSSLFYIFRHHLETNVEEPNELKDTTWKRINSVKNLNGVIKVRVNHLGTIVAVGEY

SEQ ID NO: 7988 - protein, 1398 aa, unidentified
  REGION 1..1398: note = Description of Unknown:uncultivated organism sequence
MKKILGLDLGTNSIGWALINEKENDKEKSEIIRLGVRVNPLAVDEKTNFEKGKSVTNNADRRMKRSMHRNLQRYKLRRKNLIECLLEHRIITNDAVLFELGNNSTFQTYRARAKAVTEEISLEEFARVLLMINKKRGYRSSRKVKDGEEGELIDGMEIAKRLYDENLTPGELLLDLYKKGKKNKPSFYRSDLSAEFDKIWEVQSTFYPDILTDDFKYSIRGFNKTQTSGAFYGVHQIYTAKNSGKDGYLQSLTWRTEALKHQLGIEEVAYTLADINGAINNSSKRLAMISDRSKELYFNHQTIGQYLIHRLDNNPNSSLTNIIFYRQDYMDEFEAIWEKQAQFHPELTPELKKELRDIIIFYQRDLKSCKNLVSYCELEHTQRELTIEGKKKTILTGCKVCPKSSFLFQEFKIWHTLNNLKVSVIGHQRKRIKNDKAQLSLFDDVETGALDRFLTQEEKDIIYNELSVREKMNKRDVLKLLFDNHSNLDLNFKEVEGNRTMAALFKAYQDIISMTGHGEYDFTKMPADEVLAITTEIFKGLGYKTDFLTFNPLLKGKALEQQPAYRLWHLLYSYTGDKSATGNEALLRKIQELCGFEKEYAIILANVSLVLDYGHLSAKAIRKILPHMMKGYEYSEACKMAGYNHSARSLTNEDIANKEYKSHLDEIKRNSLRNPVVEKILNQMINVVNEIVKTYGKPDEIRIEMARELKKSKEERELLDAAIRKNTAESERLRKELEEEFGIQHVTKNDILRYKLYNELKMNGYKTLYSNTYIPREELFSKRFDIEHIIPQSRLFDDSFSNKTLEVRDVNIEKGNKTAYDYVTEKYDAQGVTDYESRVEELFCNKAISRTKRNNLLMKEAEIPSDFLKRDLRDSQYIARKAREILEEMVPFVVTTTGAVTSRLREDWQLVNIMQDLNWDKYDALGLTESYTDKNGNTVKRIKEWTKRNDHRHHAMDALTIAFTKRSIVQYLSNLNARSDKSNSIYGIEQKELHRNEKDHKLVFNAPMPLHEFRAEAKKHLESILVSIKTKNKVVTKNINKAKTKDGHQQKVQLTPRGALHNETVYGKILNYEAEYKKVDGKFTEDVILRVSSKKHRDALLTRLAVFDYDPKKAFTGKNSLEKNPIWLNADHTYAVPLKVKLYKTIDVFTIKKAIDKDLKLDKVIDKRVREILQTRLDEYHGDAAKAFSNLDENPIWLNKEKGITIKRVKIKAKVSSDTSVPLHVKKDLLGNILKDAAGTPIPTDYVNTANNHHVAIFADSEGNWHEHVVSFFEATTSALLGLPIVDKNYNSEEGWKFLFSMKQNEYFVFPNEKTGFVPSEIDLMDPKNYSLISPNLYRVQKFSSSDYYFRHHLETNVEETKELRDITWKRITSLKYLEGAIKVRVNHIGSIVSVGEY

SEQ ID NO: 7989 - protein, 1398 aa, unidentified
  REGION 1..1398: note = Description of Unknown:uncultivated organism sequence
MKKILGLDLGTTSIGWALVNEKENDNEKSEIIRLGVRVNPLSVDEKTNFEKGKSITTNADRRMKRSMHRNLQRYKLRRKNLIECLLNHHIITEDTPLFEQGNNTTFKTYRARAKAVTEEISLEDFARVLLMINKKRGYKSSRKVKDSEEGELIDGMEIAKRLYEENLTPGELLLDLYNKGKRTRPTFYRSDLQAEFDRIWEEQAKFYPEILTDDFKKSIHGFNKTQTSGAFYGVHKIYTAKNSGKEGYAQSLMWRTEALKRQLDIEEVAYALADINGAINNSSKRLAMISDRSKELYFNHQTIGQYLMQRLDENPNNSLTNIIFYRQDYMDEFEAIWEKQAQYHPELTNELKKDIRDIIIFYQRDLKSCKNLVSYCELEHTEREINIDGKKKIILTGCKVCPKSSPLFQNFKIWQILNNLQVSVVGHQRKRIKKDNPQLTLFNDAETGALNRFLTQEEKDILYNELSIKDKLSKKDVLKLLFDNPKNLDLNYKEVEGNRTMATLFKAYQDIISLSGNGEYDFAKMPADEVMTTVKEIFTGLGYKTDFLTFDPLLTGKALEQQPAYRLWHLLYSYTGDKSATGNEALLDKIKEICGFEKEYATILSNVSFELDYGSLSAKAIRKILPHMMNGYEYSEACKMAGYNHSVRSLTKEELAKKEYKNRLDEIKRNSLRNPVVEKILNQMINVVNEIIKTYGKPDEIRIEMARELKKSQEERELLDAAIRKNTAESEQLRKELEEEFGIQHVTRNDILRYKLYNELKMNGYKTLYSNTYIPREELFSKRFDIEHIIPQSRLFDDSFSNKTLEARDINIEKGNMTAYDYVAGKYDEKFLADYESRIEDLFAQKVISKTKRNNLLMKEQDIPSDFLARDLRDSQYIARKSREILEDLVPFVVTTTGTVTSRLREDWQLVNLMQELNWDKYDALGLTERYTDKNGNIVKRIKDWTKRNDHRHHAMDALTIAFTKRSIVQYLSNLNARSDKSSSIYGIEQKELHRDEKDHKLVFNAPMPLNEFRAEARKHLESILVSIKAKNKVVTKNINKAKTKDGHQNKIQLTPRGALHNETVYGKIRNYEAEYRKVDGKFTEDVILRVSNQKYREALLKRLAEFDNDAKKAFTGKNSLEKNPIWLNAEHSYAVPLKIKLYKIVDVFTIKKAVDKDLKLDKIIDLKVRAILQQRLDDFGGDAAKAFSNLDDNPIWLNKEKGIAIKRVKIRAKVSSETSVPLHIKKDLFGNDLKDANGIALPTDYVNTASNHHVAIFVDEDGNWHEHVVSFFEATVNALQGLPIVDKNYKSEEGWKFLFSMKQNEYFVFPNEKTGFIPSEIDLLDPNNYPLISPNLYRVQKFSSLFYIFRHHLETNVEEPNDLRDTTWKSIRSVKNLDGAIKVRVNHIGAIVAVGEY

SEQ ID NO: 7990 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLIECLLAHHIIKDDTPLFELGNNTTFQTYRARAKAVTEEISLEDFARVLLMINKKRGYKSSRKVKDGEEGELIDGMEIAKRLYDENLTPGQLLLDLHNKGKRNRPTFYRSDLQAEFDKIWEFQSTFYPNILTDEFKSSIHGFNKSQTSGAFYGVHQISTARNNGKEGYVQALMWRTEALKRQLGIEEIAYTLADINGAINNSSKRLAMISDRSKELYFNHLTIGQYLMQILNENPNHSLTNIIFYRQDYMDEFEAIWEKQAQYHPELTLELKKEIRDIIIFYQRDLKSCKNLVGYCELEHSEREITIDGKTKTILTGCKVCPKSSFLFQDFKIWQMLNNLQVSVVGRQRKKIKKDKTQPSLFDDVETGALNRFLTQEEKDILYNELSIKEKMSKREVLKLLFDNSNSLDLNYKEIEGNRTMATLFKAYQDIISLTGNGEYDFAKMSSKEVLTITTEIFKGLGYKTDYLTFNPLLEGKSLEKQPSYRLWHLLYSYTGDKSATGNEALMKKIQELCGFEKEYATILANISLALDYGSLSAKAIRKILPYMMKGYEYSEACSLAGYKHSARSLTKDELVNKEYKSHLDEIRRNSLRNPVVEKILNQMINVINEIIKTYGKPDEIRIEMARELKKSKEERELLDAAIRKNTAESEKLRKELEEEFGIQHVTKNDILRYKLYNELKMNGYKTLYSNTYIPREELFSKRFDIEHIIPQSRLFDDSFSNKTLEVRDINIEKGNKTAYDYVAEKYDEQGIVDYESRVEELFSNNAISRTKRNNLLMKEADIPSDFLNRDLRDSQYIARKAREILEELVPFVVTTTGSVTSRLREDWQLVNIMQELNWDKYDALGLTEHYTDKNGNIVKRIKDWTKRNDHRHHAMDALTIAFTKRGIVQYLSNMNARSDKSGSIYGIEQKELHRNEKDHKLVFNAPMPLDEFRAEAKKHLKSILVSIKAKNKVVTKNINRAKMKDGRQQKIQLTPRGALHNETVYGKIRNYEAEYRKVDGKFTEDVILRVCNQRQREALLSRLTEYDNDPKRAFTGKNSLEKNPIWLKADHSYAVPLKVKLYKIVDVFTIKKAVDKDLKIDKVIDLKIRSILQARLNEYNGDASKAFANLDENPIWLNQEKGIAIKRVKIRAKVSSETSVPLHVKKDLLGNILKSSDGIALPTDYVNTASNHHVAIFIDAEGNWHEHVVSFYEATACAMLGLPIIDKNFKSEEGWKFLFSMKQNEYFVFPNEKTGFVPTEIDLTDPENYAQISPNLYRVQKFSSSFYVFRNHLETNVEEIKEQKGMSWFWVTSIKKLQGAVKVRINHLGNIVSIGEY

SEQ ID NO: 7991 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLVECLLAHHIIKDDTPLFELGNNTTFQTYRARAKAVTEEISLEDFARVLLMINKKRGYKSSRKVKDGEEGELIDGMEIAKRLYDENLTPGQLLLDLHNKGKRNRPTFYRSDLQAEFDKIWDFQSTFYPNILTDEFKSSIHGFNKSQTSGAFYGVHQISTARNSGKEGYVQALMWRTEALKRQLGIEEIAYTLADINGAINNSSKRLAMISDRSKELYFNHLTIGQYLMQLLNENPNHSLTNIIFYRQDYMDEFEAIWEKQAQYHPELTLELKKEIRDIIIFYQRDLKSCKNLVGYCELEHSEREITIDGKTKTILMGCKVCPKSSFLFQDFKIWQMLNNLQVSVVGRQRKKIKKDKTQPSLFDDVETGALNRFLTQEEKDILYNELSIKEKMSKREVLKLLFDNSNSLDLNYKEIEGNRTMATLFKAYQDIISLTGNGEYDFAKMSSKEVLTITTEIFKGLGYKTDYLTFNPLLEGKSLEKQPSYRLWHLLYSYTGDKSATGNEALMKKIQELCGFEKEYATILANISLALDYGSLSAKAIRKILPYMMKGYEYSEACSLAGYKHSARSLTKDELVNKEYKSHLDEIRRNSLRNPVVEKILNQMINVINEIIKTYGKPDEIRIEMARELKKSKEERELLDAAIRKNTAESEKLRKELEEEFGIQHVTKNDILRYKLYNELKMNGYKTLYSNTYIPREELFSKRFDIEHIIPQSRLFDDSFSNKTLEVRDINIEKGNKTAYDYVAEKYDEQGIVDYESRVEELFSNNAISRTKRNNLLMKEADIPSDFLNRDLRDSQYIARKAREILEELVPFVVTTTGSVTSRLREDWQLVNIMQELNWDKYDALGLTEHYTDKNGNNVKRIKDWTKRNDHRHHAMDALTIAFTKRGIVQYLSNMNARSDKSGSIYGIEQKELHRNEKDHKLVFNAPMPLDEFRAEAKKHLKSILVSIKAKNKVVTKNINRAKMKDGRQQKIQLTPRGALHNETVYGKIRNYEAEYRKVDGKFTEDVILRVCNQRQREALLSRLTEYDNDPKRAFTGKNSLEKNPIWLKADHSYAVPLKVKLYKIVDVFTIKKAVDKDLKIDKVIDLKIRSILQARLNEYNGDASKAFANLDENPIWLNQEKGIAIKRVKIRAKVSSETSVPLHVKKDLLGNILKSSDGIALPTDYVNTASNHHVAIFIDAEGNWHEHVVSFYEATACAMLGLPIIDKNFKSEEGWKFLFSMKQNEYFVFPNEKTGFVPTEIDLTDPENYAQISPNLYRVQKFSSSFYVFRNHLETNVEEPTMLKDTTWKSIRSIRNLDGVVKVRVNHIGEIVEVGEY

SEQ ID NO: 7992 - protein, 1398 aa, unidentified
  REGION 1..1398: note = Description of Unknown:uncultivated organism sequence
MKKILGLDLGTTSIGWALVNEKENDNEKSEIIRLGVRVNPLSVDEKTNFEKGKSITTNADRRMKRSMHRNLQRYKLRRKNLIECLLNHHIITEDTPLFEQGNNTTFKTYRARAKAVTEEISLEDFARVLLMINKKRGYKSSRKVKDSEEGELIDGMEIAKRLYEENLTPGELLLDLYNKGKRTRPTFYRSDLQAEFDRIWEEQAKFYPEILTDDFKKSIHGFNKTQTSGAFYGVHKIYTAKNSGKEGYAQSLMWRTEALKRQLDIEEVAYALADINGAINNSSKRLAMISDRSKELYFNHQTIGQYLMQRLDENPNNSLTNIIFYRQDYMDEFEAIWEKQAQYHPELTNELKKDIRDIIIFYQRDLKSCKNLVSYCELEHTEREINIDGKKKIILTGCKVCPKSSPLFQNFKIWQILNNLQVSVVGHQRKRIKKDNPQLTLFNDAETGALNRFLTQEEKDILYNELSIKDKLSKKDVLKLLFDNPKNLDLNYKEVEGNRTMATLFKAYQDIISLSGNGEYDFAKMPADEVMTTVKEIFTGLGYKTDFLTFDPLLTGKALEQQPAYRLWHLLYSYTGDKSATGNEALLDKIKEICGFEKEYATILSNVSFELDYGSLSAKAIRKILPHMMNGYEYSEACKMAGYNHSVRSLTKEELAKKEYKNRLDEIKRNSLRNPVVEKILNQMINVVNEIIKTYGKPDEIRIEMARELKKSQEERELLDAAIRKNTAESEQLRKELEEEFGIQHVTRNDILRYKLYNELKMNGYKTLYSNTYIPREELFSKRFDIEHIIPQSRLFDDSFSNKTLEARDINIEKGNMTAYDYVAGKYDEKFLADYESRIEDLFAQKVISKTKRNNLLMKEQDIPSDFLARDLRDSQYIARKSREILEDLVPFVVTTTGTVTSRLREDWQLVNLMQELNWDKYDALGLTERYTDKNGNIVKRIKDWTKRNDHRHHAMDALTIAFTKRSIVQYLSNLNARSDKSSSIYGIEQKELHRDEKDHKLVFNAPMPLNEFRAEARKHLESILVSIKAKNKVVTKNINKAKTKDGHQNKIQLTPRGALHNETVYGKIRNYEAEYRKVDGKFTEDVILRVSNQKYREALLKRLAEFDNDAKKAFTGKNSLEKNPIWLNAEHSYAVPLKIKLYKIVDVFTIKKAVDKDLKLDKIIDLKVRAILQQRLDDFGGDAAKAFSNLDDNPIWLNKEKGIAIKRVKIRAKVSSENSVPLHIKKDLFGNDLKDANGIALPTDYVNTASNHHVAIFVDEDGNWHEHVVSFFEATVNALQGLPIVDKNYKSEEGWKFLFSMKQNEYFVFPNEKTGFIPSEIDLLDPNNYPLISPNLYRVQKFSSLFYIFRHHLETNVEEPNDLRDTTWKSIRSVKNLDGAIKVRVNHIGAIVAVGEY

SEQ ID NO: 7993 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLVECLLAHHIIKDDTPLFELGNNTTFQTYRARAKAVTEEISLEDFARVLLMINKKRGYKSSRKVKDGEEGELIDGMEIAKRLYDENLTPGQLLLDLHNKGKRNRPTFYRSDLQAEFDKIWEFQSTFYPNILTDEFKSSIHGFNKSQTSGAFYGVHQISTARNNGKEGYVQALMWRTEALKRQLGIEEIAYTLADINGAINNSSKRLAMISDRSKELYFNHLTIGQYLMQLLNENPNHSLTNIIFYRQDYMDEFEAIWEKQAQYHPELTLELKKEIRDIIIFYQRDLKSCKNLVGYCELEHSEREITIDGKTKTILMGCKVCPKSSFLFQDFKIWQMLNNLQVSVVGRQRKKIKKDKTQPSLFDDVETGALNRFLTQEEKDILYNELSIKEKMSKREVLKLLFDNSNSLDLNYKEIEGNRTMATLFKAYQDIISLTGNGEYDFAKMSSKEVLTITTEIFKGLGYKTDYLTFNPLLEGKSLEKQPSYRLWHLLYSYTGDKSATGNEALMKKIQELCGFEKEYATILANISLALDYGSLSAKAIRKILPYMMKGYEYSEACSLAGYKHSARSLTKDELVNKKYKSHLDEIRRNSLRNPVVEKILNQMINVINEIIKTYGKPDEIRIEMARELKKSKEEREFLDAAIRKNTAESEKLRKELEEEFGIQHVTKNDILRYKLYNELKMNGYKTLYSNTYIPREELFSKRFDIEHIIPQSRLFDDSFSNKTLEVRDINIEKGNKTAYDYVAEKYDEQGIVDYESRVEELFSNNAISRTKRNNLLMKEADIPSDFLNRDLRDSQYIARKAREILEELVPFVVTTTGSVTSRLREDWQLVNIMQELNWDKYDALGLTEHYTDKNGNIVKRIKDWTKRNDHRHHAMDALTIAFTKRGIVQYLSNMNARSDKSGSIYGIEQKELHRNEKDHKLVFNAPMPLDEFRAEAKKHLKSILVSIKAKNKVVTKNINRAKMKDGRQQKIQLTPRGALHNETVYGKIRNYEAEYRKVDGKFTEDVILRVCNQRQREALLSRLTEYDNDPKKAFTGKNSLEKNPIWLKADHSYAVPLKVKLYKIVDVFTIKKAVDKDLKIDKVIDLKIRSILQARLNEYNGDASKAFANLDENPIWLNQEKGIAIKRVKIRAKVSSETSVPLHVKKDLLGNILKSSDGIALPTDYVNTASNHHVAIFIDAEGNWHEHVVSFYEATASALLGLPIIDKNFKSEEGWKFLFSMKQNEYFVFPNEKTGFVPTEIDLTDPKNYAQISPNLYRVQKFSSSFYVFRNHLETNVEEIKEQKGMSWFWVTSIKKLQGAVKVRINHLGNIVSIGEY

SEQ ID NO: 7994 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKTNFEKGKSITTNADRRLKRSMHRNLQRYKLRRKNLIACLLEHHIITEDTPLFEQGNNTTFKTYRARAKAATEEISLEDFARVLLMINKKRGYKSSRKVKDGEEGELIDGMEIAKRLYEENLTPGQLLLDLYNKGKRNRPTFYRSDLQAEFDKIWEVQAKYYPNILTNDFKDSIHGFNKTQTSGAFYGVHQIYTAKNSGKEGYAQSLLWRTEALKHQLDIEEVAYALADINGAINNSSKRLAMISDRSKELYFSHQTIGQYLMKRLDENPNNSLTNIIFYRQDYMDEFETIWEKQAQYHPELTKELKKEIRDIIIFYQRDLKSCKNLVSYCELEHTEREIIIDGKKKVILTGCKVCPKSSLLFQNFKIWQILNNLQVSVVGTQRKRIKKDKTQLSLFNDAETGALNRFLTQEEKDILYNELSIKDKLSKKEVLKLLFDNPKNLDLNYKEVEGNRTMATLFKAYQDIISLSGNGEYDFSKMPAEEVLPLVKEIFTGLGYKTDFLTFNPLLDGKALEQQPAYRLWHLLYSYTGDNSATGNEALLQKIQDICGFEKEYATILSNASFAIDYGSLSAKAIRKILPHMMKGYEYSEACKMAGYNHSVRSLTKDELANKEYKNRLDEIKRNSLRNPVVEKILNQMINVVNEIIKTYGKPDEIRIEMARELKKSQEERELLDAAIRKNTAESEQLRKELEKEFGIQHVTRNDILRYKLYNELKMNGYKTLYSNTYIPREELFSKRFDIEHIIPQSRLFDDSFSNKTLEARDINIEKGNMTAYDYVAGKYDEKYLADYESRIEDLFAQKVISRTKRNNLLMKAEDIPSDFLARDLRDSQYIAKKAREILEDLVPFVVTTTGAVTSRLREDWQLVNLMQELNWDKYDALGLTERYTDKNGNIVKRIKDWTKRNDHRHHAMDALTIAFTKRSFVQYLSNLNARSDKSSSIYGIEQKELHRDEKDHKLVFNAPMPLNEFRAEARKQLESILVSIKAKNKVVTKNINKAKTKDGHLNKVQLTPRGALHNETVYGKIQNYEAEYRKVDGKFTEDVILRVSNQKCREALLKRLAEFDNDPKKAFTGKNSLEKNPIWLNAEHSYAVPLKVKLYKVVDVFTIKKAVDKDLKLDKVIDLKVRAILQQRLDEYDGDATKAFSNLDDNPIWLNKEKGIAIKRVKIRGIANGEAIRVKRDNKGAIIKDENGNPIPNDFVNTGNNHHVAVFRDANGKLQEHVVSFYEATTRATLGYPIVDKNYNRSEGWEFLFSMKQNEYFVFPNEKTGFNPQNINLLDANNWRQISPNLYRVQKFTTGDYVFRHHLETNVESENALRDITWKRIRAIQNLDGIIKVRLNHLGNIVAVGEY

SEQ ID NO: 7995 - protein, 1398 aa, unidentified
  REGION 1..1398: note = Description of Unknown:uncultivated organism sequence
MKKILGLDLGTTSIGWALVNEKENDNEKSEIIRLGVRVNPLSVDEKTNFEKGKSITTNADRRMKRSMHRNLQRYKLRRKNLIECLLNHHIITEDTPLFEQGNNTTFKTYRARAKAVTEEISLEDFARVLLMINKKRGYKSSRKVKDSEEGELIDGMEIAKRLYEENLTPGELLLDLYNKGKRTRPTFYRSDLQAEFDRIWEEQAKFYPEILTDDFKKSIHGFNKTQTSGAFYGVHKIYTAKNSGKEGYAQSLMWRTEALKRQLDIEEVAYALADINGAINNSSKRLAMISDRSKELYFNHQTIGQYLMQRLDENPNNSLTNIIFYRQDYMDEFEAIWEKQAQYHPELTNELKKDIRDIIIFYQRDLKSCKNLVSYCELEHTEREINIDGKKKIILTGCKVCPKSSPLFQNFKIWQILNNLQVSVVGHQRKRIKKDNPQLTLFNDAETGALNRFLTQEEKDILYNELSIKDKLSKKDVLKLLFDNPKNLDLNYKEVEGNRTMATLFKAYQDIISLSGNGEYDFAKMPADEVMTTVKEIFTGLGYKTDFLTFDPLLTGKALEQQPAYRLWHLLYSYTGDKSATGNEALLDKIKEICGFEKEYATILSNVSFELDYGSLSAKAIRKILPHMMNGYEYSEACKMAGYNHSVRSLTKEELAKKEYKNRLDEIKRNSLRNPVVEKILNQMINVVNEIIKTYGKPDEIRIEMARELKKSQEERELLDAAIRKNTAESEQLRKELEEEFRIPHVTKNDILRYKLYNELKMNGYKTLYSNTYIPREELFSKRFDIEHIIPQSRLFDDSFSNKTLEARDINIEKGNMTAYDYVAGKYDEKFLADYESRIEDLFAQKVISKTKRNNLLMKEQDIPSDFLARDLRDSQYIARKSREILEDLVPFVVTTTGTVTSRLREDWQLVNLMQELNWDKYDALGLTERYTDKNGNIVKRIKDWTKRNDHRHHAMDALTIAFTKRSIVQYLSNLNARSDKSSSIYGIEQKELHRDEKDHKLVFNAPMPLNEFRAEARKHLESILVSIKAKNKVVTKNINKAKTKDGHQNKIQLTPRGALHNETVYGKIRNYEAEYRKVDGKFTEDVILRVSNQKYREALLKRLADFDNDAKKAFTGKNSLEKNPIWLNAEHSYAVPLKIKLYKIVDVFTIKKAVDKDLKLDKIIDLKVRAILQQRLDDFGGDAAKAFSNLDDNPIWLNKEKGIAIKRVKIRAKVSSETSVPLHIKKDLFGNDLKDANGIALPTDYVNTASNHHVAIFVDEDGNWHEHVVSFFEATVNALQGLPIVDKNYKSEEGWKFLFSMKQNEYFVFPNEKTGFIPSEIDLLDPNNYPLISPNLYRVQKFSSLFYIFRHHLETNVEEPNDLRDTTWKSIRSVKNLDGAIKVRVNHIGAIVAVGEY

SEQ ID NO: 7996 - protein, 1089 aa, unidentified
  REGION 1..1089: note = Description of Unknown:uncultivated organism sequence
MKPAISEDNIFEFEPFEEDGSLLMAAETPWRGMADELQELHYLKGAKFINQLKLIIYYGEFHLVEGETNIYSAISENSDDFDNLINAARKAVEHGYRVYILPNPKSFRTADFIFEKKGVLGLYDLKTVYGKGSVGTQLLDSIGQTNRVLLNMTTDYNTRLLASDIKKYFETNPDAVEVLIFKGHNYIEVEGNRTMATLFKAYQDIISLTGNGEYDFSKMPADEARSITSEIFTGLGYKTDFLSFNPLFEGKALEQQPAYRLWHLLYSYTGDKSVTGNEALLAKIQELCGFEKEYATILSNVSLALDYGSLSAKAIRKILPHMMKGYEYSEACKMAGYNHSARSLTKEELANKEYKSRLDIIKRNSLRNPVVEKILNQMINVINEIIKTYGKPDEIRIEMARELKKSQEERELLDAAIRKNTAESEKLRKELEEEFGIQHVTRNDILRYKLYNELKLNGYKTLYSNTYIPREELFSKRFDIEHIIPQSRLFDDSFSNKTLEVRDINIEKGNMTAYDYVAGKYDEKYLIDYESRVEELFAQKVISRTKRNNLLMKEEDIPSDFLERDLRDSQYIARKSREILEELVSFVVTTTGAVTSRLREDWQLVNIMQESNWNKYDALGLTEHYTDKNGNIVKRIKDWTKRNDHRHHAMDALTIAFTKRSIVQYLSNMNARSDKSSSIYGIEQKELHRDEKNHNLVFNAPMPLNEFRAEAKKHLESILVSIKAKNKVVTKNINKGKTKDGHQQIVQLTPRGALHNETVYGKIRNYEAEYRKVDGKFTEEVILRVSNQKCREALLNRLAEYDNNPKKAFTGKNSLEKNPIWLNADHSHAVPLKVKLYKIVDVFTIKKAVDKDLKIDKVIDNKIRAILQQRLDEFVGDAAKAFSNLDENPIWLNEEKGIAIKRVKIRGIANGEPIRVKRDIKGNIIKDENGNPIPNDYVNTGNNHHVAVFRDKEGKLQEHVVSFYEATTRAILGYPIVDKEYRHSEGWEFLFSMKQNEYFVFPNEKTGFKPQEIDLLNANNWGIISPNLYRVQKFTTGDYFFRHHLETNVESDNALRDITWKRIRSIQDLDGIVKVRLNHLGSIVTVGEY

SEQ ID NO: 7997 - protein, 1393 aa, unidentified
  REGION 1..1393: note = Description of Unknown:uncultivated organism sequence
MKKILGLDLGTTSIGWALVNEKEKDNEKSSIIRLGVRVNPLTVDEKSNFEKGKSITTNADRRMKRSMHRNLQRYKLRRQHLIECLKEHGIINDTTPLFELGNHSTFKTYRARAKAVDEEISLEEFARVLLMINKKRGYKSNRKIKDTEEGELVDGMEIAKRLYDENLTPGQLLLDLYQKGKKTRPAFYRSDLQAEFDRIWEVQSVFYPEILNNDFKKHISGFNKTQTSGAFYAIYSISTTKNSGKEAYAQSLRWRCDALKKQLNIETVAYVLCDINGAINNSSKRLAMISDRSKELYFNHQTVGQYLVQCIDHNPNASLKNIIFYRQDYLDEFETIWERQAQYHQELTPELKKEVRDIIIFYQRNLKSCKNLINYCEFEHTEKEILVEGKKKTIMIGCKVCPKSSPLFQCFKIWQVLNNLQVSVVGHQRKRIKKDDFQLALFADTEGEPLQRFLDQEEKDILFKELTIRDKMSKKEILKLLFDNPQKLDLNYKEVEGNNTMATIIKACQEIISLTGNGDFNFSKMPADDVLAVTTEIFSGLGYKTDFLTFNPLLEGKAMEEQPFYQLWHLLYSYAGDNSISGNEALIKKIHDLCGFEKEYATVLANVSMPLDYGNLSAKAIRKILPFMMKGYEYSKACELAGYRHSARSLTRDELSKREYTSHLSELKRNSLRNPVVEKILNQMINVVNEIVATYGKPDEIRIELARELKNSKEEREQMDIAIRKNTADSEKYRKILEEEFGIQHATRNDIIRYKLYNELKQNGYKTLYSNTYIPREELFSKRFDIEHIIPKARIFDDSFSNKTLEVRDINIEKGDMTAYDFVAGKYDEKGVLDYEKRVEELVTNNAISKTKRNNLLMKEADIPSDFLQRDLRDSQYIAKKAREILEQMVPFVVTTTGSITKRLREDWQLVGVMQELNWQKYDSLGLTETYFDKNGNVVRHIKNWTKRNDHRHHAMDALTIAFTKRSIVQYLNNMNARSDKSSSIYGIEQKELNRDNKDHKLVFNAPMPLNEFRAEAKKHLDSILVSIKAKNKVVTKNINRAKTKDGHQHKIQLTPRGALHNETVYGKIKNFEAEYRIVDGKFTEDTVFRVSNRRYREALAQRLAAFGNDPKKAFTGKNSLEKNPIWLNADHSYSVPLKVKLYKIVDVFTIKKAVDKDLKIDKVIDGRIRELLQQRLNEFNGDAAKAFSNLDDNPIWLNKEKGIAIKRVKIRGIASGEPIRVKRDAKGGIMNDEHGNPIPNDYVNTANNHHVAVFRDASGNLHERVVSFYEATTRAMMGYPIIDKDYKQAEGWQFLFSMKQNEYFVFPSDGFNPSEIDLTDPQNYSLISPNLYRVQKFSEGDYFFRHHLETTVETDNSLKNITWKRINSVKSLEGIVKVRVDHIGRIVSVGEY

SEQ ID NO: 7998 - protein, 1398 aa, unidentified
  REGION 1..1398: note = Description of Unknown:uncultivated organism sequence
MKRILGLDLGTNSIGWALVNEKEDDTEKSSIVRLGVRVIPLSIDEKTNFEKGKSITTNADRRQKRSMRRNLQRYKLRRKALIDCLVEHGIISNDTPLFELGNGTTFQTYRVRAKAANEEISLEEFARVLLMLNKKRGYKSNRKIKDTEDDGGELIDGMELAKRLYEEDLTPGQVLYDYIRKGKKNKLSFYRSDLQNEFNRIWEIQSRFYPIILTDHFKETITGLNKTQTSGAFYHTYNISTAKNTGKDRDYVSLKWRVDALTKELGIEEVAYVLCDLNGAINNSSKRLAMISDRSKELYFNQLTVGQYLMRLLDNNPNTSLKNIIFYRQDYLDEFETIWEKQSQFHPQLNSNLKKEIRDIIIFYQRDLKSCKNLVSYCELEHTEKDVIVEGKKKTIIIGSKVCPKSSPLFQDFKIWQVLNNIQVSVIGVKNKKRNGDGASLFLEFGDQVTQRFLNQEEKDILYKELSIKEKMSKKEVLKLLFDNPNKLDLNFKDVEGNKTMAAFFKAFQDIINLSGHGEYDFSKMRADEVIDITAQIFSGFGYKTDFLSFNPLLSGKSLEQQPFYHLWHLLYSYVGDKSKTGEEALINKISEICGFEKEYARIISRISLPLDYGSLSAKAIRKLLPHMMNGFEYSAACEKVGYRHSARSLTKDELDSKEYKSKLDELKRNSLRNPVVEKILNQMINVVNEIIATYGKPDEIRIELARELKKSQEEREDLDKAIRKNTAESERIKEILEKEFHIAHVSRNDIIRYKLYEELKPNGYKTIYSDTYIPREQLFSKRFDIEHIIPKARLFDDSFSNKTLEARDINIEKGDMTAFDFIASKYDENGIATYQSRVEELFAHYAISKTKRTNLLRTESDIPSDFLERELRDSQYIAKKAREILEELVPFVVTTTGSITSRLREDWQLVNIMQELNWEKYDKQGLTETYIDKNGNTVRRIKDWTKRNDHRHHAMDALTIAFTKRSLIQYLNNLNARSDKGSSIYGIEQKELHRDAKSHKLLFNPPIPIDEFRAEAKKHLQNILVSIKAKNKVVTKNLNKFKSKGSIRKKVQLTPRGSLHNETVYGKITNFEAEYKKVDGKFNEETILRVSSKKYRDALLKRLYENGNNPKKAFTGKNSLENNPIWLDESHTHQVPAKVKLFKVINVFTTRKAIDKDLKIDKVIDKKIRAILEQRLKEYDDKAEKAFSGLDDNPIWLNEEKGISVKRVKVKAKVSTDSSVPLHVKKNLLGNFMVDEKGGKIPTDYVTTSGNHHAAIFIDSNGNLQEHIVTFYEATASALLGLPIVDKNYKSEEGWKFLFSMKQNEYFVFPNQETGFQPTEIDLKDPNNYALISQNLYRVQKFSSLYYVFRHHLETNVEETNALKGITWKRIQNLKSLMGIVKVRVNHLGMIVAVGEY

SEQ ID NO: 7999 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLIECLLEHHIISDETLLYEQGNNTTFQTYRARAKAVTEEISLEDFARVLLMINKKRGYKSSRKVKDGEEGELIDGMEIAKRLYEENMTPGQLLLDLYNKGKKNRPTFYRSDLQAEFDKIWNTQSAFYPNILTDDFKSSIHGFNKTQTAGAFYGVHQITTAKNAGKEGYAQALSWRTDALNRQLGIEEVAYILADINGAINNSSKRLAMISDRSKELYFNHQTIGQFLMKRLDENPNNSLTNIIFYRQDYMDEFEVIWEKQAQYHPELTSELKKEIRDIIIFYQRDLKSCKNLVSYCELEHTEREITIGSKKKTILTGCKVCPKSSLLFQDFKIWQILNNLQVSVVGRQRKKIKKDNTQPSLFDDVETSALTRFLTQEEKDILYNELSIKDKMSKKEVLKLLFDNHNSLDLNYKEVEGNRTMAALFKAYQDIISLTGNGEYDFAKMPTDEVMNVTTEIFRGLGYKTDFLTFDPLLEGKSLEQQHAYRLWHLLYSYTGDNSATGNEALLNKIKELCGFEKEYAVILSNIPLALDYGSLSAKAIRKILPHMMKGYEYSEACKMAGYNHSARSLTKEELAKKEYKSCLDEIRRNSLRNPVVEKILNQMINVVNEIVKTYGKPEEIRIEMARELKKSQEERELLDAAIRKNTAESEKLRKELEDEFGIQHVTRNDILRYKLYNELKLNGYKTLYSNTYIPREDLFSKRFDIEHIIPQSRLFDDSFSNKTLEVRDINIEKGNMTAYDYVAGKFDEKYLVDYESRIEELYTQKAISKTKRNNLLMKKENIPSDFLERDLRDSQYIARKAREILEELVPFVVTTTGAVTSRLREDWQLVNLMQELNWDKYDALGLTERYTDKNGNIVKRIKDWTKRNDHRHHAMDALTIAFTKRSIVQYLSNLNARSDKSSSIYGIEQKELHRDEKDHKLVFNAPMPLNEFRAEAKKHLESILVSIKAKNKVVTKNINKSKTKDGHQNKIQLTPRGALHNETVYGKIRNYEAEYRKVDGKFTEDIFLRVSSQKHREALLKRLAEFDNDPKKAFTGKNSLEKNPIWLNEDHSHAVPLKVKLYKIVDVFTIKKAVDKDLKLDKVIDDKVRTILQQRLDEFGGDAAKAFSNLDENPIWLNKEKGIAIKRVKIRGIANGEPIRVKRDVMGNIIKDENGNPIPNDFVNTGNNHHVAVFRDASGKLQEHVVSFYEATTRAILGYPIVDKEYNRSEGWEFLFSMKQNEFFVFPNEKTGFNPQETDLMDANNWSAISPNLYRVQKFTTGDYFFRHHLETNVENSNNLKDITWKRINSANNLAGIVKVRLNHLGEIVAIGEY

SEQ ID NO: 8000 - protein, 1395 aa, unidentified
  REGION 1..1395: note = Description of Unknown:uncultivated organism sequence
MKKILGLDLGTTSIGWALVNEKENDKEKSEIIRLGVRVNPLTVDEKTNFEKGKSITTNADRRMKRSMHRNLQRYKLRRKNLIECLLEHHIISDETLLYEQGNNTTFQTYRARAKAVTEEISLEDFARVLLMINKKRGYKSSRKVKDGEEGELIDGMEIAKRLYEENMTPGQLLLDLYNKGKKNRPTFYRSDLQVEFDKIWNTQSAFYPNILTDDFKSSIHGFNKTQTAGAFYGVHQITTAKNAGKEGYAQALSWRTDALNRQLGIEEVAYILADINGAINNSSKRLAMISDRSKELYFNHQTIGQFLMKRLDENPNNSLTNIIFYRQDYMDEFEVIWEKQAQYHPELTSELKKEIRDIIIFYQRDLKSCKNLVSYCELEHTEREITIGSKKKTILTGCKVCPKSSLLFQDFKIWQILNNLQVSVVGRQRKKIKKDNTQPSLFDDVETSALTRFLTQEEKDILYNELSIKDKMSKKEVLKLLFDNHNSLDLNYKEVEGNRTMAALFKAYQDIISLTGNGEYDFAKMPTDEVMNVTTEIFRGLGYKTDFLTFDPLLEGKSLEQQHAYRLWHLLYSYTGDNSATGNEALLNKIKELCGFEKEYAVILSNIPLALDYGSLSAKAIRKILPHMMKGYEYSEACKMAGYNHSARSLTKEELAKKEYKSCLDEIRRNSLRNPVVEKILNQMINVVNEIVKTYGKPEEIRIEMARELKKSQEERELLDAAIRKNTAESEKLRKELEDEFGIQHVTRNDILRYKLYNELKLNGYKTLYSNTYIPREDLFSKRFDIEHIIPQSRLFDDSFSNKTLEVRDINIEKGNMTAYDYVAGKFDEKYLVDYESRIEELYTQKAISKTKRNNLLMKEENIPSDFLERDLRDSQYIARKAREILEELVPFVVTTTGAVTSRLREDWQLVNLMQELNWDKYDALGLTERYTDKNGNIVKRIKDWTKRNDHRHHAMDALTIAFTKRSIVQYLSNLNARSDKSSSIYGIEQKELHRDEKDHKLVFNAPMPLNEFRAEAKKHLESILVSIKAKNKVVTKNINKSKTKDGHQNKIQLTPRGALHNETVYGKIRNYEAEYRKVDGKFTEDIILRVSSQKHREALLKRLAEFDNDPKKAFTGKNSLEKNPIWLNEDHSHAVPLKVKLYKIVDVFTIKKTVDKDLKLDKVIDDKVRTILQQRLDEFGGDAAKAFSNLDENPIWLNKEKGIAIKRVKIRGIANGEPIRVKRDVMGNIIKDENGNPIPNDFVNTGNNHHVAVFRDASGKLQEHVVSFYEATTRAILGYPIVDKEYNRSEGWEFLFSMKQNEYFVFPNEKTGFNPQETDLMDANNWSTISPNLYRVQKFTTGDYGVRHHLETNVESENVLRDITWKRIRSVQGLDGVVKVRLNHLGEIVAIGEY

SEQ ID NO: 8001 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKSNFERGKSITTNADRRLKRSMRRNLQRYKLRRKNLIECLLEHHIITDETPLFEQGNNTTFQTYRARAKAVTEEITLEEFARVLLMINKKRGYKSSRKVKDGEEGELIDGMEIAKRLYEENITPGRLLLDLYMKGKKNRPTFYRSDLQAEFDKIWEVQSAFYPEILTDDFKSSLRGFNRTQTSGAFYGVHKITTAQNTGKDRYLQSLAWRNDALHQKIDIEEVAYALADINGAINNSSKRLAMISDRSKEIYFSHKTIGQYLMQRLDENPNNSLTNIIFYRQDYMDEFEAIWEKQAQYHPELTPELKKEIRDIIIFYQRDLKSCKNLVSYCELEHSEREITIDGKKKTILTGCKVCPKSSPLFQDFKIWQILNNLQVSVVGHQKKRIKKDKLQLSLFDDAETGALNRFLTQEEKDILYNELSIKEKMSKKDVLKLLFDNPKSLDLNYKEVEGNRTMATLFKAYQDIISLTGNGEYDFSKMSADEARSITTEIFTGLGYKTDFLSFNPLLEGKALEQQPAYRLWHLLYSYTGDKSVTGNEALLAKIQELCGFEKEYATILSNVSLALDYGSLSAKAIRKILPHMMKGYEYSEACKMAGYNHSARSLTKEELASKEYKSRLDIIKRNSLRNPVVEKILNQMINVINEIIKTYGKPDEIRIEMARELKKSQEERELLDAAIRKNTAESEKLRKELEEEFGIQHVTRNDILRYKLYNELKLNGYKTLYSNTYIPREELFSKRFDIEHIIPQSRLFDDSFSNKTLEVRDINIEKGNMTAYDYVAGKYDEKYLVDYESRVEELFAQKVISRTKRNNLLMKEEDIPSDFLERDLRDSQYIARKAREILEELVPFVVTTTGAVTSRLREDWQLVNLMQELNWDKYDALGLTERYTDKNGNIVKHIKDWTKRNDHRHHAMDALTIAFTKRSIVQYLSNLNARSDKSGSIYGIEQKELHRDEKYHKLVFNAPMPLNEFRAEAKKHLECILVSIKAKNKVVTKNINKGKTKDGHQQKVQLTPRGTLHNETVYGKIRNYEAEYRKVDGKFTEEVILRVSNQKCREALLKRLAEFDGDPKKAFTGKNSLEKNPIWLNADHSHAVPQKVKLYKIVDVFTIKKAVDKDLKIDKVIDNKVRAILQQRLDEFGGDASKAFSNLDENPIWQNKEKGIAIKRVKIRGIANGEPVRIKRDIMGNIMKDENGNPIPNDYVNPGNNHHVAVFRDKEGKLQEHVVSFYEATTRAILGYPIVDKEYRHSEGWEFLFSMKQNEYFVFPNEKTGFKPQEMDLLNVNNWGKISPNLYRVQKFTTGDYVFRHNLETNVESENALRDITWKRIRSIQDLDGIIKVRLNHLGSIVAVGEY

SEQ ID NO: 8002 - protein, 1399 aa, unidentified
  REGION 1..1399: note = Description of Unknown:uncultivated organism sequence
MKKVLGLDLGTTSIGWALVNEKENDNEKSSIIRLGVRVNPLTVDEKTNFEKGKSITTNADRRLKRSMHRNLQRYKLRRANLIECLKEHNIITEETPLFELGNKTTFSTYRNRAKAVEEEISLEDFARVLLMINKKRGYKSSRKVNNDEEGELVDGMEIAKKLYNENLTPGQLLLNLFRKGKRIRPSFYRSDLQAEFDKIWLFQSSFYPEVLTEDFKKSISNFNKGQTSGAFHNVYKISTAKNSGKGGYEQALIWRTEALTRQLDIEELAYVLSDINGAINNSSKRLALISDRSKELYFNDLTVGQYLVKQMEEHPHKSLKNIIFYRQDYMDEFEAIWEKQAQYHPELTPQLKKEIRDIILFYQRDLKSCKQLVNYCEFEHAEKEVVIEGKRKKILTGAKVCPKSSPLFQDFKVWQILNNLEVSVVGHRRRKTKAQNNQLFLFSEEDEGLMVDRRFLNQEEKEILFKELSVRGKMTKSEVLSLLFAKPKELDLNYKEIECNNTMVAFYKACQEVISLSGHGEYDFSKMPADKVISLTLEIFSGLGFKTDFLFFDALKSGKDLEKQPAYRLWHLLYSYSGDKSKTGDEALINKICAICGFGNNKEYAKPFANISLALDYGSLSAKAIRKILPYMMQGYEYSKACEKVGFNHSARSLTTEELKEKNYTSHLNEIRRNSLRNPVVEKILNQMINVVNEIAATYGKPDEIRIELARELKKSKEEREKLDKAIRENTNESEALRKELETDFKIKNVTRNDILRYKLYKELKLNGYKTLYSNTYIPREELFSNKFDIEHIIPKARLFDDSFSNKTIEARGINIEKGDMTAYDYVAGKYNDQQLAEYESRVEELFSKKVISRTKRNHLLMKQDEIPTDFLNRDLGDSQYIAKKAREILEAMVPMVVSTTGSITSRLREDWQLVNIMKELNWEKYNSLGLTESYTDKNGNTIRHIKNWSKRNDHRHHAMDALTIAFTKRSIVQYLNNLNARSDKSGSIYGIEKNELHRDEKDHKLLFNAPMPLDEFRAEAKKHLENILVSIKAKNKVVTKNINKVKIKGGHHNKTQLTPRGPLHNETVYGKILNFEAENKNVDGRFTEETILRVSNQKYRAALLKRLSDFGGDPKKAFTGKNKLDKNPIWLNEDHSHCVPLKVKLFKKVDVFTIRKAIDKDLKIDKVIDCKVRDILQKRLDEFGGDAAKAFSNLEDNPIWLNKEKGIDIKRVKIRGIANGEPLRIKRDVKGNIIKDERGIAVPNDFVNTANNHHVAIFMDEKGGLHEHMVSFYEASTRAIMGLPIIDKSFNQDIAWKFLFSMKQNEYFVFPNEDTGFSPHEIDLTDQNNYSLISPNLFRVQKISNGDYYFRHHLETNVEEVKELRNITWKRIRTIKELDGIVKVRINHLGIIVSVGEY

SEQ ID NO: 8003 - protein, 1399 aa, unidentified
  REGION 1..1399: note = Description of Unknown:uncultivated organism sequence
MKKVLGLDLGTTSIGWALVNEKENDNEKSSIIRLGVRVNPLTVDEKTNFEKGKSITTNADRRLKRSMHRNLQRYKLRRANLIECLKEHDIITEETPLFELGNNTTFSTYRNRAKAVEEEISLEDFARVLLMINKKRGYKSSRKVKNDEEGELVDGMEIAKKLYNENLTPGQLQLNLFKKGKRIRPSFYRSDLQAEFDKIWLFQSSFYPEVLTDAFKKSISNLNKGQTSNAFHNVYKISTAKNSGKGGYEQALIWRTEALTRQLDIEELAYVLSDINGAINNSSKRLALISDRSKELYFNDLTVGQYLVKQMEEHPHKSLKNIIFYRQDYMDEFEAIWEKQAQYHPELTPQLKKEIRDIIIFYQRDLKSCKQLVNYCEFEHAEKEVVIEGKLKKILTGAKVCPKSSPLFQDFKVWQILNNLEVSIVGHQRKKTKVQTNQLFLFSEEDEGLMVDRRFLNQEEKEILFKELSVRGKMNKSEVLSLLFAKPKELDLNYKEIECNNTMVAFYKACQEIISLSGHGEYDFSKMPADKVISLTLEVFSGLGFNTDFLFFDALKSGKDFEKQPAYQLWHLLYSYSGDNSKTGDEALINKICAICGFGDNKEYAKPFANIPLVLDYGSLSAKAIRKILPYMMQGYEYSKACEEAGYNHSARSLTTEELKEKTYTSHLNEIKRNSLRNPVVEKILNQMINVVNEIAATYGKPDEIRIELARELKKSKEEREKLDKAIRENTNESETLRKELETEFKIKNVTRNDILRYKLYKELKLNGYKTLYSNTYIPQEELFSNKFDIEHIIPKARLFDDSFANKTIEVRSINIEKGDMTAYDYVAGKYNDQQLAEYESRVEELFSKKVISRTKRNHLLMKQEEIPENFLERDLRDSQYIAKKAREILEAMVPMVVSTTGSITSRLREDWQLVDIMKELNWEKYNSLGLTESYTDKNGNTVRHIKDWSKRNDHRHHAMDALTIAFTKRSIVQYLNNLNARSDKSSSIYGIEKNELHRDEKDHKLLFNAPMPLDEFRAEAKKHLESILVSIKAKNKVVTKNINKSKIKGGHQNKTQLTPRGPLHNETVYGKILNFEAEYKNVDGKFTEETILRVSNQKFRAALLKRLSDYGGDPKKAFTGKNKLDKNPIWLNEDHSHCVPLKVKLFKKVDVFTIRKAIDKDLKIDKVIDCKVKDILQKRLDEFGGDAAKAFSNLEDNPIWLNKEKGIDIKRVKIRGIANGEPLRIKRDVKGNIIKNERGIAVPNDFVNTANNHHVAIFMDEKGVLHEHMVSFYEATTRAIMGLPIIDKSFNQDLGWKFLFSMKQNEYFVFPNEETGFSPHEIDLTDQNNYSLISPNLFRVQKISNGDYFFRHHLETNVEEVKELRNITWKRIRTIKELDGIVKVRINHLGIIVSVGEY

SEQ ID NO: 8004 - protein, 895 aa, unidentified
  REGION 1..895: note = Description of Unknown:uncultivated organism sequence
MATLFKAYQDIISLSGNGEYDFSKMPAEEVLPLVKEIFTGLGYKTDFLTFNPLLDGKALEQQPAYRLWHLLYSYTGDNSATGNEALLQKIQDICGFEKEYATILSNASFALDYGSLSAKAIRKILPHMMKGYEYSEACKMAGYNHSVRSLTKDELANKEYKNRLDEIKRNSLRNPVVEKILNQMINVVNEIIKTYGKPDEIRIEMARELKKSQEERELLDAAIRKNTAESEQLRKELEKEFGIQHVTRNDILRYKLYNELKMNGYKTLYSNTYIPREELFSKRFDIEHIIPQSRLFDDSFSNKTIEARDINIEKGNMTAYDYVAGKYDEKYFADYESRIEDLFAQKVISRTKRNNLLMKAEDIPSDFLARDLRDSQYIAKKAREILEDLVPFVVTTTGAITSRLREDWQLVNLMQELNWDKYDALGLTERYTDKNGNIVKRIKDWTKRNDHRHHAMDALTIAFTKRSFVQYLSNLNARSDKSSSIYGIEQKELHRDEKDHKLVFNAPMPLNEFRAEARKQLESILVSIKAKNKVVTKNINKAKTKDGHQNKVQLTPRGALHNETVYGKIQNYEAEYRKVDGKFTEDVILRVSNQKCREALLKRLAEFDNDPKKAFTGKNSLEKNPIWLNAEHSYAVPLKVKLYKVVDVFTIKKAVDKDLKLDKVIDLKVRAILQQRLDEYDGDAAKAFSNLDDNPIWLNKEKGIAIKRVKIRGIANGEAIRVKRDNKGAIIKDENGNPIPNDFVNTGNNHHVAVFRDANGKLQEHVVSFYEATTRATLGYPIVDKNYNRSEGWEFLFSMKQNEYFVFPNEKTGFNPQNINLLDANNWRQISPNLYRVQKFTTGDYVFRHHLETNVESENALRDFTWKRIRAIQNLDGIIKVRLNHLGNIVAVGEY

SEQ ID NO: 8005 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKTNFEKGKSITTNADRRLKRSMHRNLQRYKLRRKNLIACLLEHHIITEDTPLFEQGNNTTFKTYRARAKAATEEISLEDFARVLLMINKKRGYKSSRKVKDGEEGELIDGMEIAKRLYEENLTPGQLLLDLYNKGKRNRPTFYRSDLQAEFDKIWEVQAKYYPNILTNDFKDSIHGFNKTQTSGAFYGVHQIYTAKNSGKEGYAQSLLWRTEALKHQLDIEEVAYALADINGAINNSSKRLAMISDRSKELYFSHQTIGQYLMKRLDENPNNSLTNIIFYRQDYMDEFEPIWEKQAQYHPELTKELKKEIRDIIIFYQRDLKSCKNLVSYCELEHTEREIIIDGKKKVILTGCKVCPKSSLLFQDFKIWQILNNLQVSVVGTQRKRIKKDKTQLSLFNDAETGALNRFLTQEEKDILYNELSIKDKLSKKDVLKLLFDNPKNLDLNYKEVEGNRTMATLFKAYQDIISLSGNGEYDFSKMPAEEVLPLVKEIFTGLGYKTDFLTFNPLLDGKALEQQPAYRLWHLLYSYTGDNSATGNEALLQKIQDICGFEKEYANILSNASFALDYGSLSAKAIRKILPHMMKGYEYSEACKMAGYNHSVRSLTKDELANKEYKNRLDEIKRNSLRNPVVEKIMNQMINVVNEIIKTYGKPDEIRIEMARELKKSQEERELLDAAIRNNTAESEQLRKELEKEFGIQHVTRNDILRYKLYNELKMNGYKTLYSNTYIPREELFSKRFDIEHIIPQSRLFDDSFSNKTLEARDINIEKGNMTAYDYVAGKYDEKYLADYESRIEDLFAQKVISRTKRNNLLMKAEDIPSDFLARDLRDSQYIAKKAREILEDLVPFVVTTTGAVTSRLREDWQLVNLMQELNWDKYDALGLTERYTDKNGNIVKRINDWTKRNDHRHHAMDALTIAFTKRSFVQYLSNLNARSDKSSSIYGIEQKELHRDEKDHKLVFNAPMPLNEFRAEARKQLESILVSIKAKNKVVTKNINKAKTKDGHQNKVQLTPRGALHNETVYGKIQNYEAEYRKVDGKFTEDVILRVSNQKCREALLKRLAEFDNDPKKAFTGKNSLEKNPIWLNAEHSYAVPLKVKLYKVVDVFTIKKAVDKDLKLDKVIDLKVRAILQQRLDEYDGDAAKAFSNLDDNPIWLNKEKGIAIKRVKIRGIANGEAIRVKRDNKGAIIKDENGNPIPNGFVNTGNNHHVAVFRDANGKLQEHVVSFYEATTRATLGYPIVDKNYNRSEGWEFLFSMKQNEYFVFPNEKTGFNPQNINLLDANNWRQISPNLYRVQKFTTGDYVFRHHLETNVESENALRDITWKRIRAIQNLDGIIKVRLNHLGNIVAVGEY

SEQ ID NO: 8006 - protein, 1399 aa, unidentified
  REGION 1..1399: note = Description of Unknown:uncultivated organism sequence
MKKVLGLDLGTTSIGWALVNEKENDNEKSSIIRLGVRVNPLTVDEKTNFEKGKSITTNADRRLKRSMHRNLQRYKLRRANLIECLKEHNIITEETPLFELGNKTTFSIYRNRAKAVEEEISLEDFARVLLMINKKRGYKSSRKVNNDEEGELVDGMEIAKKLYNENLTPGQLLLNLFRKGKRIRPSFYRSDLQAEFDKIWLFQSSFYPEVLTEDFKKNISNFNKGQTSGAFHNVYKISTAKNSGKGGYEQALIWRTEALTRQLDIEELAYVLSDINGAINNSSKRLALISDRSKELYFNDLTVGQYLVKQMEEHPHKSLKNIIFYRQDYMDEFEAIWEKQAQYHPELTPQLKKEIRDIIIFYQRDLKSCKQLVNYCEFEHAEKEVVIEGKRKKILTGAKVCPKSSPLFQDFKVWQILNNLEVSVVGHRRRKTKAQNNQLFLFSEEDEGLMVDHRGLNLEEKEILFKELSVRGKMNKSEVLSLLFAKPKELDLNYKEIECNNTMVAFYKACQEVISLSGHGEYDFSKMPADKVISLTLEIFSGLGFKTDFLFFDALKSGKDLEKQPAYRLWHLLYSYSGDKSKTGDEALINKICAICGFGNNKEYAKPFANISLALDYGSLSAKAIRKILPYMMQGYEYSKACEKVGFNHSARSLTTEELKEKNYTSHLNEIRRNSLRNPVVEKILNQMINVVNEIAATYGKPDEIRIELARELKKSKEEREKLDKAIRENTNESEALRKELETDFKIKNVTRNDILRYKLYKELKLNGYKTLYSNTYIPREELFSNKFDIEHIIPKARLFDDSFSNKTIEARGINIEKGDMTAYDYVAGKYNDQQLAEYESRVEELFSKKVISRTKRNHLLMKQDEIPTDFLNRDLGDSQYIAKKAREILEAMVPMVVSTTGSITSRLREDWQLVDIMKELNWEKYNSLGLTESYTDKNGNTIRHIKNWSKRNDHRHHAMDALTIAFTKRSIVQYLNNLNARSDKSGSIYGIEKNELHRDEKDHKLLFNAPMPLDEFRAEAKKHLENILVSIKAKNKVVTKNINKVKIKGGHHNKTQLTPRGPLHNETVYGKILNFEAEYKNVDGKFTEETILRVSNQKYRAALLKRLSDYGGDPKKAFTGKNKLDKNPIWLNEDHSHCVPLKVKLFKKVDVFTIRKAIDKDLKIDKVIDCKVRDILQKRLDEFGGDAAKAFSNLEDNPIWLNKEKGIDIKRVKIRGIANGEPLRIKRDVKGNIIKDERGIAVPNDFVNTANNHHVAIFMDEKGGLHEHMVSFYEASTRAIMGLPIIDKSFNQDIAWKFLFSMKQNEYFVFPNEETGFSPHEIDLTDQNNYSLISPNLFRVQKISNGDYYFRHHLETNVEEVKELRNITWKRIRTIKELDGIVKVRINHLGIIVSVGEY

SEQ ID NO: 8007 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKSNFEKGKSITTNADRRMKRSMHRNLQRYKLRRKNLIECLLEHHIITDETPLFEKGNNTTFQTYRARAKAVTEEISLEDFARVLLMINKKRGYKSSRKVKDCEEGELIDGMEIAKRLYEENITPGQLLLDLYNKGKRNRPTFYRSDLQAEFDKIWAMQSTFYPEILTDDFKSSIRGFNKMQTSGAFYGVHQIYTAKNSGKEGYAQALLWRTEALKHQMDIEEVAYALADINGAINNSSKRLAMISDRSKELYFDHLTIGQYLMKRLDENPNNSLTNISFYRQDYMDEFETIWEKQAQYHPELTQELKKEIRDIIIFYQRDLKSCKNLVSYCELEHTEREITIDGKKKTILTGCKVCPKSSPLFQDFKIWQILNNLQVSVVGRQRKKIKKDKNQLSLFDDVETGALNRFLTQEEKEILYNELSIKEKLSKKDVLKLLFDNHNSLDLNYKEVEGNRTMAALFKAYQDIISLTGNGEYDFSKMPTDEVMNITSEIFKGLGYKTDFLTFNPLLKGKSLEQQPVYRLWHLLYSYTGDKSATGNEALLNRIQELCGFEKEYAVILSNISFALDYSSLSAKAIRKILPHMMKGFEYSEACKMAGYNHSERSLTKEELAQKEYKSHLDEIKRNSLRNPVVEKILNQMINVVNELIKTYGKPDEIRVEMARELKKNQEERELLDAAIRKNTAESEKLRKELEEEFGIQHVTRNDILRYKLYNELKLNGFKTLYSNTYIPREDLFSKRFDIEHIIPQSRLFDDSFSNKTLEVRDINIEKGNKTAYDYVSEKYDEQGVTDYESRVEELFNNKVISRTKRNNLLMKEADIPSDFLNRDLRDSQYIARKAREILEELVPFVVTTTGAVTSRLREDWQLVNIMQELNWEKYDALGLTEQYTDKNGNIVKRIKDWTKRNDHRHHAMDALTIAFTKRSIVQYLSNMNARSDKSGSIYGIERKELHRDEKDHKLVFNAPMPLDIFRAEAKKHLECILVSIKAKNKVVTKNINKSKTKNGHQQKVQLTPRGALHNETVYGKIQNYEAEYKKVDGKFTEDVILRVSSQKHREALLKRLAEYGNDPKKAFTGKNSLEKNPIWLNADHSYAVPLKVKLYKIVDVFTIKKAVDKDLKLDKVIDNKVRAILQARLDEFNGDAAKAFSNLDENPIWLNKEKGIAIKRVKIKAKVSSDTSVPLHVKKDLIGNILKDSDGKALPTDYVNTANNHHVAIFVDNDGNWHEHVVSFYEATASALLGLPIVDKNYKSEEGWKFLFSMKQNEYFVFPNEKTGFVPSEIDLTDPKNYSLISPNLYRVQKFSSLFYIFRHHLETNVEEPNELRDMTWKSIRSVKNLNGAIKVRVNHIGSIVAVGEY

SEQ ID NO: 8008 - protein, 1394 aa, unidentified
  REGION 1..1394: note = Description of Unknown:uncultivated organism sequence
MKRILGLDLGTTSIGWALVNEKESDNEQSSIVRLGVRVNPLTVDEKSNFEKGKSITTNADRRMKRSMHRNLQRYKLRRKNLIECLIENGIISEDTPLFELGNKSTFNTYKARAKAVEEEISLEDFARVLLMINKKRGYKSSRKIKETEEGELVDGMEIAKKLYQEDITPGQLLLELYQQGKKNRPAFYRSDLQAEFDKIWDVQSKFYPAILSQEFKKTVTGLNKTQTSATFYSIKSISTTKNSGKEAYAQALRWRTEALSKQLDIEEVAYVLADINGAINNSSKRLAMISDRSKELYFNHLTVGQYLMKSLELNPHASLKNIIFYRQDYLDEFETIWEKQAQFHHELTPELKKDIRDIVIFYQRNLKSCKNLVSYCELEHQEKEVVIDGKKKVIFTGCKVCPKSSPLFQDFKIWQVLNNLEVSVAEHKPQKAKEQSQASLFGSAEMSSLRRFLEQEEKEKLFKELSVKDKMNKKEILKLLFDNPQSLDLNYKEVEGNRTNAAFIKAYQDIISFTGNGEYDFSKMKADDILALITEIFQGLGYRTDFLTFNPLLNGKDFEQQPYYRLWHLLYSYAGDNSTTGNEALIKKIGEICGFEKEYAAILASITLPLDYCSLSAKAIRNILPHMMDGYEYSKACEMAGYRHSARSMTKQELDAKAYKDHLDILKRNSLRNPIVEKILNQMINVVNEIIDTYGKPDEIRIELARELKKSQEERALLDEAIRKTTADSEKYRKELETEFGIQHVTKNDILRYRLYLELKPIGFKTPYSNTYIPREELFSKRFDIEHIIPKARLFDDSFSNKTLEVRDVNIEKGNMTAIDFVSGKYDEQGVAEYESRVEELYAHKAISRTKRNKLLMKEADIPADFLERDLRDSQYIAKKAREILEGIVPFVVTTTGTVTSRLREDWQLVNLMQELNWNKYAALGLTESYTDKNGNVVRHIKDWTKRNDHRHHAMDALTIAFTKRSIVQYLSNLNARSDKGSSIYGIEQKELHRDEKGHKLVFNAPMPLDEFRAEARKHLESILVSIKAKNKVVTKNINRAKKKNGHQEKVQLTPRGALHNETVYGKIKNYEAEYRKVDGKFSEETILRVCNLKYRNALLKRLSEFNNDPKKAFTGKNSLEKNPLWLNEDHSHCVPTKVKLYRIVDVFTIKKAVDKDLKIDKVIDKKIRERLQARLDEFNGDAAKAFANLDENPIWLNQEKGIAVKRVKIRGIANGEPIRIKRDVRGNSIKDANGNTIPNDYVNTANNHHVAVFRDAAGNLQEHVVSFYEATTRAIMGYPIVDKDYNSDEGWKFLFSMKQNEYFVFPNPKTGFNPQEIDLLDEKNMPLVSPNLYRVQKFTTGDYVFRHHLETNVESDNVLRDVTWKRIRSIKELESIVKVRVNHIGIIVAVGEY

SEQ ID NO: 8009 - protein, 924 aa, unidentified
  REGION 1..924: note = Description of Unknown:uncultivated organism sequence
MSKRDVLKLLFDNPKNLDLNYKEVEGNRTMAALFKAYQDIISLSGNGEYDFSKMLADEVISITTEIFTGLGYKTDFLSFNPLLEGKALEQQPAYRLWHLLYSYTGDKSVTGNEALLAKIQELCGFEKEYATILSNVSLALDYGSLSAKAIRIILPHMMKGYEYSEACKMAGYNHSARSLTKEELANKEYKSRLDIIKRNSLRNPVVEKILNQMINVINEIIKTYGKPDEIRIEMARELKKSQEERELLDAAIRKNTAESEKLRKELEDEFSIQHVTRNDILRYKLYNELKLNGYKTLYSNTYIPREELFSKRFDIEHIIPQSRLFDDSFSNKTLEVRDINIEKGNMTAYDYVAGKYDEKYVADYESRVEELFNQKVISKTKRNNLLMKEEEIPSDFLERDLRDSQYIARKAREILEELVPFVVTTTGAVTSRLRDDWQLVNIMQELNWDKYDALGLTERYTDKNGNIVRRIKDWTKRNDHRHHAMDALTIAFTKRSHVQYLSNMNARSDKSSSIYGIEQKELHRDEKDHKLVFNAPMPLNEFRAEAKKHLESILVSIKAKNKVVTKNINKGKTKDGHQQKVQLTPRGALHNETVYGKIRNYEAEYRKVDGKFTEDVILRVSNQKYRNALLKRLTECGNDAKKAFTGKNSLEKNPIWLNADHSYCVPLKVKLYKIVDVFTIKKSVDKDLKIDKVIDNKVREILQQRLDEFGGDAAKAFSNLDENPIWLNKEKGIAIKRVKIRGIANGEPVRIKRDVKGNIIKDENGNPIPNDYVNTGNNHHVAVFRDAAGKLQEHVVSFYEATTRAILGYPIVDKEYRRSEGWKFLFSMKQNEYFVFPNEKTSFKPQEIDLLNADNWSIISPNLYRVQKFTTGDYVFRHHLETNVESEIALRDITWKRIRAIQNLEGIVKVRLNHLGNIVAVGEY

SEQ ID NO: 8010 - protein, 924 aa, unidentified
  REGION 1..924: note = Description of Unknown:uncultivated organism sequence
MSKRDVLKLLFDNPKNLDLNYKEVEGNRTMAALFKAYQDIISLSGNGEYDFSKMLADEVISITTEIFTGLGYKTDFLSFNPLLEGKALEQQPAYRLWHLLYSYTGDKSVTGNEALLAKIQELCGFEKEYATILSNVSLALDYGSLSAKAIRRILPHMMKGYEYSEACKMAGYNHSARSLTKEELANKEYKSRLDIIKRNSLRNPVVEKILNQMINVINEIIKTYGKPDEIRIEMARELKKSQEERELLDAAIRKNTAESEKLRKELEDEFSIQHVTRNDILRYKLYNELKLNGYKTLYSNTYIPREELFSKRFDIEHIIPQSRLFDDSFSNKTLEVRDINIEKGNMTAYDYVAGKYDEKYVADYESRVEELFNQKVISKTKRNNLLMKEEEIPSDFLERDLRDSQYIARKAREILEELVPFVVTTTGAVTSRLRDDWQLVNIMQELNWDKYDALGLTERYTDKNGNIVRRIKDWTKRNDHRHHAMDALTIAFTKRSHVQYLSNMNARSDKSSSIYGIEQKELHRDEKDHKLVFNAPMPLNEFRAEAKKHLESILVSIKAKNKVVTKNINKGKTKDGHQQKVQLTPRGALHNETVYGKIRNYEAEYRKVDGKFTEDVILRVSNQKYRNALLKRLTECGNDAKKAFTGKNSLEKNPIWLNADHSYCVPLKVKLYKIVDVFTIKKSVDKDLKIDKVIDNKVREILQQRLDEFGGDAAKAFSNLDENPIWLNKEKGIAIKRVKIRGIANGEPVRIKRDVKGNIIKDENGNPIPNDYVNTGNNHHVAVFRDAAGKLQEHVVSFYEATTRAILGYPIVDKEYRRSEGWEFLFSMKQNEYFVFPNEKTSFKPQEIDLLNADNWSIISPNLYRVQKFTTGDYVFRHHLETNVESEIALRDITWKRIRAIQNLEGIVKVRLNHLGNIVAVGEY

SEQ ID NO: 8011 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLIECLLEHHIISDETLLYEQGNNTTFQTYRARAKAVTEEISLEDFARVLLMINKKRGYKSSRKVKDGEEGELIDGMEIAKRLYEENMTPGQLLLDLYNKGKKNRPTFYRSDLQAEFDKIWNTQSAFYPNILTDDFKSSIHGFNKTQTAGAFYGVHQITTAKNAGKEGYAQALSWRTDALNRQLGIEEVAYILADINGAINNSSKRLAMISDRSKELYFNHQTIGQFLMKRLGENPNNSLTNIIFYRQDYMDEFEVIWEKQAQYHPELTSELKKEIRDIIIFYQRDLKSCKNLVSYCELEHTKREITIGSKKKTILTGCKVCPKSSLLFQDFKIWQILNNLQVSIVGRQRKKIKKDNTQPSLFDDVETSALTRFLTQEEKEILYNELSIKEKMSKKEVLKLLFDNHNSLDLNYKEVEGNRTMAALFKAYQDIISLTGNGEYDFAKMPTDEVMNVTTEIFRGLGYKTDFLTFDPLLEGKSLEQQHAYRLWHLLYSYTGDNSATGNEALLSKIKELCGFEKEYAIILSNIPLALDYGSLSAKAIRKILPHMMKGYEYSEACKMAGYNHSARSLTKEELAKKEYKSCLDEIRRNSLRNPVVEKILNQMINVVNEIVKTYGKPEEIRIEMARELKKSQEERELLDAAIRKNTAESEKLRKELEDEFGIQHVTRNDILRYKLYNELKLNGYKTLYSNTYIPREDLFSKRFDIEHIIPQSRLFDDSFSNKTLEVRDINIEKGNMTAYDYVAGKFDEKYLVDYESRIEELYTQKAISKTKRNNLLMKEENIPSDFLERDLRDSQYIARKAREILEELVPFVVTTTGAVTSRLREDWQLVNLMQELNWDKYEALGLTERYTDKNGNIVKRIKDWTKRNDHRHHAMDALTIAFTKRSIVQYLSNLNARSDKSSSIYGIEQKELHRDEKDHKLVFNAPMPLNEFRAEAKKHLESILVSIKAKNKVVTKNINKSKTKDGHQNKIQLTPRGALHNETVYGKIRNYEAEYRKVDGKFTEDIILRVSSQKHREALLKRLAEFDNDPKKAFTGKNSLEKNPIWLNEDHSHAVPLKVKLYKIVDVFTIKKAVDKDLKLDKVIDDKVRTILQQRLDEFGGDAAKAFSNLDENPIWLNKEKGIAIKRVKIRGIANGEPIRVKRDVMGNIIKDENGNPIPNDFVNTGNNHHVAVFRDASGKLQEHVVSFYEATTRAILGYPIVDKEYNRSEGWEFLFSMKQNEYFVFPNEKTGFNPQETDLMDANNWSAISPNLYRVQKFTTGDYFFRHHLETNVENSNNLKDITWKRINSANNLAGIVKVRLNHLGEIVAIGEY

SEQ ID NO: 8012 - protein, 1384 aa, unidentified
  REGION 1..1384: note = Description of Unknown:uncultivated organism sequence
MRFFYKFAIIKREITMKKILGLDLGTTSIGWALVNESENDSEKSSIVRLGVRVNPLTVDEKGSLEKGKAVTVNAERANKRGARRNIQRYKLRRDNLKKLLINNGLINSDSPLYECSNDRFALYRYRALAVTQQIPIQDFARVLLMINKKRGYKSMRKVNTDEDGTLVDGMDVAKILFERQITPAQYLLDFYRKGKKISPQFYRSDLLAELDRIWTEQSKYYPEILTAELHNAIDGKNISACSRAFYALTHIDTAKNSGKDRMLTALTWRVDALTKKLPEEEMAYVICNLNGEINGSSQHLNLIGDRSKVLFFNHQTIGQYLWKQIQKAPQKSLANIIFYRQDYEDEFNLIWDKQAEYYPQLLTNNLKKEIRKVIFFQRPLKSAKGLLAYCELEHKTKQVVIDGKIKTITIGCKVCPKSSPLFQEFKIWQQLNNVKISQENVQRSLTLEEMQLLFEELNIKGKMKSADALKTIGFKRKDVSINFSELEGNTTNNRLFTAYLKIISDSGNGEYDIKKLSAKQVLNYVEEIFKGLGYNTDFLHFDASLVGKNYYEQPYYRLWHLLYSYAGDNSKTGNEALLNKLCKLCGFEKEYARTLSSVVFENDYGNLSTKAIRKILPFLKEGNQYSDACVFAGYGSHSTRSLTKERLEKKEYVSKLQQVSRNSLRNPVVEKILNQMINVVNQVVELYGKPDEIRIEMARELKKSREERETLSSAINKNTTETERIRKILEKEFKISHVTHNDIIRYRLYEELKDNGYKTLYSQTYIPREEIFGPKFNIEHIIPQARLFDDSFSNKTLEAVDINIEKANDTAYDYVIKKYGNDGAEDYKSRVQDLIKRNAISRTKGSKLLMKQEDIPSDFIERDLRSSQYIAKKALEILEQMVPRVVATTGSITNRLREDWQLVNVMQELNWNKYNRLGLTYSYADKNGNIVYRIKDWTKRNDNRHHAMDALTIAFTKSSYIQYLNNLNARSDKGGVIYAIEKKELHRDNKSNKLTFNAPMPLGEFRTEARKQLDNILVSRKAKNKVVTENVNKTKCKNGCLRKIQLTPRGALHNEHVQGMVKRYEIYYLKVNDKLTAEKISEVASQKIREVLLQRLQECDGNAKLAFRKLSKNPIWLDKDNNVQVPTKVKAVHFIEYYTIKKAIAPDLKIEKVEDTGVQRILKARLEEYNGDANAAFSNLEENPIWFNREKCIAIKSVKVKVLNNATAIHVKHDHKGEVILDKNGNSIPCDFVNTGNNHHIAIFEDADGNLQEHVVSFFEVTERVRQHLPIVDRNYNSANGWKFLFSMKQDEYFVFPNLKDNFNPIDYDLKDKKNYSLISPNLFRVQKMGKGDYVFRHHLETNVEQNKDLKDITWKRYRTPNGLKGAIKVRVNHIGDIVDVGEY

SEQ ID NO: 8013 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKTNFEKGKSITTNADRRLKRSMHRNLQRYKLRRKNLIACLLEHHIITEDTPLFEQGNNTTFKTYRARAKAATEEISLEDFARVLLMINKKRGYKSSRKVKDGEEGELIDDMEIAKRLYEENLTPGQLLLDLYNKGKRNRPTFYRSDLQAEFDKIWEVQAKYYPNILTNDFKDSIHGFNKTQTSGAFYGVHQIYTAKNSGKEGYAQSLLWRTEALKHQLDIEEVAYALADINGAINNSSKRLAMISDRSKELYFSHQTIGQYLMKRLDENPNNSLTNIIFYRQDYMDEFETIWEKQAQYHPELTKELKKEIRDIIIFYQRDLKSCKNLVSYCELEHTEREIIIDGKKKVILTGCKVCPKSSLLFQNFKIWQILNNLQVSVVGTQRKRIKKDKTQLSLFNDAETGALNRFLTQEEKDILYNELSIKDKLSKKEVLKLLFDNPKNLDLNYKEVEGNRTMATLFKAYQDIISLSGNGEYDFSKMPAEEVLPLVKEIFTGLGYKTDFLTFNPLLDGKALEQQPAYRLWHLLYSYTGDNSATGNEALLQKIQDICGFEKEYATILSNASFAIDYGSLSAKAIRKILPHMMKGYEYSEACKMAGYNHSVRSLTKDELANKEYKNRLDEIKRNSLRNPVVEKILNQMINVVNEIIKTYGKPDEIRIEMARELKKSQEERELLDAAIRKNTAESEQLRKELEKEFGIQHVTRNDILRYKLYNELKMNGYKTLYSNTYIPREELFSKRFDIEHIIPQSRLFDDSFSNKTLEARDINIEKGNMTAYDYVAGKYDEKYLADYESRIEDLFAQKVISRTKRNNLLMKAEDIPSDFLARDLRDSQYIAKKAREILEDLVPFVVTTTGAVTSRLREDWQLVNLMQELNWDKYDALGLTERYTDKNGNIVKRIKDWTKRNDHRHHAMDALTIAFTKRSFVQYLSNLNARSDKSSSIYGIEQKELHRDEKEHKLVFNAPMPLNEFRAEARKQLESILVSIKAKNKVVTKNINKAKTKDGHQNKVQLTPRGALHNETVYGKIQNYEAEYRKVDGKFTEDVILRVSNQKCREALLKRLAEFDNDPKKAFTGKNSLEKNPIWLNAEHSYAVPLKVKLYKVVDVFTIKKAVDKDLKLDKVIDLKVRAILQQRLDEYDGDAAKAFSNLDDNPIWLNKEKGIAIKRVKIRGIANGEAIRVKRDNKGAIIKDENGNPIPNDFVNTGNNHHVAVFRDANGKLQEHVVSFYEATTRATLGYPIVDKNYNRSEGWEFLFSMKQNEYFVFPNEKTGFNPQNINLLDANNWRQISPNLYRVQKFTTGDYVFRHHLETNVESENALRDITWKRIRAIQNLDGIIKVRLNHLGNIVAVGEY

SEQ ID NO: 8014 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLIECLLEHHIITDNTPLFEQGNNTTFKTYRARAKAATEEISLEDLTRVLLMINKKRGYKSSRKVKDGEEGELIDGMEIAKRLYEENLTPGQLLLDLYNKGKRNRPTFYRSDLQAEFDRIWEMQAKFYPDILTNDFKTSIHGFNKTQTSGAFYGVHQIYTAKNSGKEGYIQSLVWRTEALQHQLDIEEVAYALADINGAINNSSKRLAMISDRSKELYFNHQTIGQYLMQRLDENPNNSLTNIIFYRQDYMDEFETIWEKQAQYHPELTKELKKEIRDIIIFYQRDLKSCKNLVSYCELEHTEREINIDGKKKVILTGCKVCPKSSLLFQNFKIWQILNNLQVSVIGTQRKRIKKDKNQPSLFNDAETSALNRFLTQEEKDILYNELSIKEKLSKKDVLKLLFDNPKNLDLNYKEVEGNRTMAALFKAYQDIISLSGNGEYDFSKMPTDEVLAIVKEIFTGLGYKTDFLSFNPLLDGKALEQQPAYRLWHLLYSYTGDNSATGNEALLQKIKDICGFEKEYATILSNVSFALDYGSLSAKAIRKILPHMMKGYEYSEACKMAGYNHSVRSLTKEELAKKEYKNRLDEIKRNSLRNPVVEKILNQMINVVNEIIKTYGKPDEIRIEMARELKKSQEERELLDAAIRKNTAESEQLRKELEEEFRIPHVTRNDILRYKLYNELKMNGYKTLYSNTYIPREELFSKRFDIEHIIPQSRLFDDSFSNKTLEARDINIEKGNMTAYDYVAGKYDEKYLADYESRIEDLFAQKVISRTKRNNLLMKEEDIPSDFLARDLRDSQYIAKKAREILEDLVPFVVTTTGAVTSRLREDWQLVNLMQELNWDKYDALGLTERYTDKNGNIVKRIMDWTKRNDHRHHAMDALTIAFTKRSIVQYLSNLNARSDKSSSIYGIEQNELHRDEKDHKLVFNAPMPLNEFRAEARKQLESILVSIKAKNKVVTKNINKAKTKDRHQNKVQLTPRGALHNETVYGKIHNYEAEYRKVDGKFTEDVILRVSNQKCREALLKRLAEFENDPKKAFTGKNSLEKNPIWLNAEHSYAVPLKVKLYKILDVFTIKKAVDKDLKLDKVIDTKVRAILQLRLDEFSGDAAKAFSNLDDNPIWLNKEKGIAIKRVKIRGIANGEAIRVKRDNKGAIIKDENGNPIPNDFVNTGNNHHVAVFRDANGKLQEHVVSFYEATTRATLGYPIVDKDYNRSEGWEFRFSMKQNEYFVFPNEKTGFNPQDVNLLDASNWSRISPNLYRVQKFATGDYVFRHHLETNVESENALRDITWKRIRAIQNLDGIVKVRLNHLGNIVAVGEY

SEQ ID NO: 8015 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKANFEKGKAITTNADRRMKRSMHRNLQRYKLRRKNLIECLVEHHVISDETPLFEKGNNTTFQTYRARAKAVTEEISLEDFARVLLMINKKRGYKSSRKVKDGEEGELIDGMEIAKRLYEENLTPGQLLFDLYNKGKKNRPTFYRSDLQAEFDKIWEVQSAFYPNILTDDFKSSVHGYNKTQTSGAFYGVHQISTAKNSGKEGYVQSLIWRTEALKHQLDIEEVAYALADINGAINNSSKRLAMISDRSKELYFNHQTIGQYLMQRLDENPNNSLTNIIFYRQDYMDEFEAIWEKQAQYHPKLTPELKREIRDIIIFYQRDLKSCKNLVSYCELEHSEREVTIDGKKKIILTGCKVCPKSSPLFQDFKIWQILNNLQVSVVGHQRKRIKKDKSQLSLFDDTETGALNRFLTQEEKDTLYNELSIKEKMSKRDVLKLLFDNPKNLDLNYKEVEGNRTMAALFKAYQDIISLTGNGEYDFSKMPADEVKSIITEIFTGLGYKTDFLTFDSLLEGKALELQPAYRLWHLLYSYTGDKSATGNEALLAKIQDLCGFEKEYATILANVSLALDYGGLSAKAIRKILPHMVKGYEYSEACTMAGYNHSARSLTKEELAKKEYKSRLDIIKRNSLRNPVVEKILNQMINVINEIIKTYGKPDEIRIEMARELKKSQEERELLDAAIRKNTAESEKLRKELEEEFGIQYVTRNDILRYKLYNELKLNGYKTLYSNTYIPREELFSKRFDIEHIIPQSRLFDDSFSNKTLEVRDINIEKGNMTAYDYVAGKYDEKYLVDYESRVEELFAQKVISRTKRNNLLMKEEDIPSDFLERDLRDSQYIARKAREILEELVPYVVTTTGAVTSRLREDWQLVNLMQELNWDKYDALGLTERYTDKNGNIVKRIKDWSKRNDHRHHAMDALTIAFTKRSIVQYLSNMNARSDKSSSIYGIEQKELHRDEKDHKLVFNTPMPLDVFLAETRKHLESILVSIKAKNKVVTKNINKVKTKDGHQQKVQLTPRGALHNETVYGKIRNYEAEYRKVDGKFTEEVILRVSNQKCREALLKRLAEFDNDPKKAFTGKNSLEKNPIWLNANHSYAVPLKVKLYKIVDVFTIKKAVDKDLKIDKVIDNKVRAILQQRLDEFGGDAAKAFSNLDENPIWLNKEKGIAIKRVKIRAKVSSDTSVPLHVKRDLLGNLLKDAEGRALPTDYVNTANNHHVAIFVDSEGNWHEHVVSFFEATTSALLGLPIVDKNYKREEGWKFLFSMKQNEYFVFPNEKTGFVPFEIDLMDPKNYALISPNLYRVQKFSSSFYVFRHHLETNVDESNELKETTWKRITSVKGLERVIKVRINHLGNVVVVGEY

SEQ ID NO: 8016 - protein, 1398 aa, unidentified
  REGION 1..1398: note = Description of Unknown:uncultivated organism sequence
MKKILGLDLGTTSIGWALVNEKENDNEKSEIIRLGVRVNPLTVDEKTNFEKGKSITTNADRRMKRSMHRNLQRYKLRRKNLVECLLAHHIIKDDTPLFELGNNTTFQTYRARAKAVTEEISLEDFARVLLMINKKRGYKSSRKVKDGEEGELIDGMEIAKRLYDENLTPGQLLLDLHNKGKRNRPTFYRSDLQAEFDKIWEFQSTFYPNILTDEFKSSIHGFNKSQTSGAFYGVHQISTARNNGKEGYVQALMWRTEALKRQLGIEEIAYTLADINGAINNSSKRLAMISDRSKELYFNHLTIGQYLMQLLNENPNHSLTNIIFYRQDYMDEFEAIWEKQAQYHPELTLELKKEIRDIIIFYQRDLKSCKNLVGYCELEHSEREITIDGKTKTILTGCKVCPKSSFLFQDFKIWQMLNNLQVSVVGRQRKKIKKDKTQPSLFDDVETGALNRFLTQEEKDILYNELSIKEKMSKREVLKLLFDNSNSLDLNYKEIEGNRTMATLFKAYQEIISLTGNGEYDFAKMSSKEVLTITTEIFKGLGYKTDYLTFNPLLEGKSLEKQPSYRLWHLLYSYTGDKSATGNEALMKKIQELCGFEKEYATILANISLALDYGSLSAKAIRKILPYMMKGYEYSEACSLAGYKHSARSLTKDELVNKEYKSHLDEIRRNSLRNPVVEKILNQMINVINEIIKTYGKPDEIRIEMARELKKSKEERELLDAAIRKNTAESEKLRKELEEEFGIQHVTKNDILRYKLYNELKMNGYKTLYSNTYIPREELFSKRFDIEHIIPQSRLFDDSFSNKTLEVRDINIEKGNKTAYDYVAEKYDEQGIVDYESRVEELFSNNAISRTKRNNLLMKEADIPSDFLNRDLRDSQYIARKAREILEELVPFVVTTTGSVTSRLREDWQLVNIMQELNWDKYDALGLTEHYTDKNGNIVKRIKDWTKRNDHRHHAMDALTIAFTKRGIVQYLSNMNARSDKSGSIYGIEQKELHRNEKDHKLVFNAPMPLDEFRAEAKKHLKSILVSIKAKNKVVTKNINRAKMKDGRQQKIQLTPRGALHNETVYGKIRNYEAEYRKVDGKFTEDVILRVCNQRQREALLSRLTEYDNDPKKAFTGKNSLENNPIWLKADHSYAVPLKVKLYKIVDVFTIKKAVDKDLKIDKVIDLKIRSILQARLNEYNGDASKAFANLDENPIWLNQEKGIAIKRVKIRAKVSSETSVPLHVKKDLLGNILKSSDGIALPTDYVNTASNHHVAIFIDAEGNWHEHVVSFYEATASAMLGLPIIDKNFKSEEGWKFLFSMKQNEYFVFPNEKTGFVPTEIDLTDPENYAQISPNLYRVQKFSSSFYVFRNHLETNVEEPTMLKDTTWKSIRSIRNLDGVVKVRVNHIGEIVEVGEY

SEQ ID NO: 8017 - protein, 1371 aa, unidentified
  REGION 1..1371: note = Description of Unknown:uncultivated organism sequence
MKKILGLDLGTTSIGWAVVNEATNKEEKSSIVKLGVRVNPLTVDEQTNFEKGKPITTNADRTLKRSMRRNLQRYKLRREHLISCLKENGFITDDSILCENGNRTTFETYRLRAKAATEEISLEELARVLLMINKKRGYKSSRKAKSNDEGELVDGMSVAKTLYEEDITPGQYSLQLLCNGKKYLPDFYQSDLRVELQKIWEKQQTFYPDILTPDFMQVLEGKSKTNTSKIFYARYGIHTADNKSKDKKRQAYEWRVDGLTRQLNIEEVAYVISDLNGLINGSSGYLGKISDRSKNLYFNKLTVGQYLMQELDKNPNVSLKNQVFYRQDYLDEFETIWNTQSQYHPELTCELKKDIGNMIIFYQRPLKSQKGLVAICELENEQREVEVDGVKKLITTGCKVCPKSSPLFQEFRMWQRLNDVIVYDSNAKADLFGNGTATKRRLTEEEMNTLAFELNIKGKLTKQQALKCLFGKATGLDMNFKELDGNETQAKLFEAYLKIVEMSGHEGYDYAKLNASQIFDVVEKVFAGLGFNTAPLYFDASIEGKQFDKQPMYQLWHLLYSYEGDNSKTGDESLVKKIRDIFHFDNDDYAKIIAGISFKPDYGSLSAKAIKKILPFMKAGNDYSLACEYAQYNHSKRSLTKEELEKKELKDHLDLLPKNSLRNPVVEKILNQMINVVNEVVKTYGPLDEIRIEMARDLKMNAKKREEKTSEINRMNAYHEDIKKILQAAPFNIEHVSRNDIIRYKLYEELKDNGYKTLYSNTYISKEKLFSREFDIEHIIPQARLFDDSFSNKTLESRSINQEKGNATAFDFVKEKYGEEGAKAYKQRIDELLKQQVLSKAKHDKLLMTIDDIPEDFIMRDLRDTQYIARKAREILEQIVKVVVPTNGKITHKLREDWQLINVMQELNAPKFQELGLTEKDWTKRNDHRHHAMDALTIAFTKLSIIQYLNNLNARSDKSSSIYGIEQKELYRDKHGHMRFLPPIPLDEFRVEAKQQLEQILVSIKSKTKVVTRNVNKSKSKKAEKGLNKRVQLTPRGQLHNETIYGSSQRYVTKEEKIGSSFDAEKIATVANKAYREALRHRLDAYDGDAKKAFTGKNSLEKAPIWLDDLHTRAVPIKVKCVTMETIYTIRKPISKDLRIVKVVDKHIQDILRARLEEYGGDANRAFSNLDENPIWLNEEKGIRIKSVAINAGLSKPEAIHVKRNQFGKPILNERGNKQAADFVQTANNHHVAIFRDANGKLQEHIVSFYEATMRANQGWPIIDKEYNQTEGWEFLFSMKQNEYFVFPDKDFCPADYDLMNPDNYAIISPHLFRVQKLASKDYFFRHHLETTVEDKNELRDMTWKRIRNCDELQGIVKVRVNHIGQIVAVG

SEQ ID NO: 8018 - protein, 1395 aa, unidentified
  REGION 1..1395: note = Description of Unknown:uncultivated organism sequence
MKKILGLDLGTTSIGWALVNEKENDNEKSEIIRLGVRVNPLTVDEKSNFERGKSITTNADRRLKRSMHRNLQRYKLRRKNLIECLLEHHIITDDTPLFEHGNNTTFQTYRARAKAVTEEITLEEFARVLLMINKKRGYKSSRKVKDGEEGELIDGMEIAKRLYEENITPGRLLLDLYMNGKKNRPTFYRSDLQAEFDKIWEVQSAFYPEILTDDFKSSLRGFNRTQTSVAFYGVHKITTAQNNGKDKYLQSLAWRNDALYQKIDIEEVAYALADINGAINNSSKRLAMISDRSKELYFNHQTIGQYLMQRLDANPNNSLTNIIFYRQDYMDEFEAIWERQAQYHPELTPELKKEIRDIIIFYQRDLKSCKNLVSYCELEHTEREITIDGKKKTILTGCKVCPKSSPLFQDFKIWQILNNLQVSVVGHKRKRIKKDKSQLSLFDDAETGALNRFLTQEEKDILYNELSIKDKMSKKDVLKLLFDNPKDLDLNYIEVEGNRTMATLFKAYQDIISLTGNGEYDFSKMPADEARSITSEIFTGLGYKTDFLSFNPLFEGKALEQQPAYRLWHLLYSYTGDKSVTGNEALLAKIQELCGFEKEYATILSNVSLALDYGSLSAKAIRKILPHMMKGYEYSEACKMAGYNHSARSLTKEELANKEYKSRLDIIKRNSLRNPVVEKILNQMINVINEIIKTYGKPDEIRIEMARELKKSQEERELLDAAIRKNTAESEKLRKELEEEFGIQHVTRNDILRYKLYNELKLNGYKTLYSNTYIPREELFSKRFDIEHIIPQSRLFDDSFSNKTLEVRDINIEKGNMTAYDYVAGKYDEKYLIDYESRVEELFAQKVISRTKRNNLLMKEEDIPSDFLERDLRDSQYIARKSREILEELVSFVVTTTGAVTSRLREDWQLVNIMQESNWNKYDALGLTEHYTDKNGNIVKRIKDWTKRNDHRHHAMDALTIAFTKRSIVQYLSNMNARSDKSSSIYGIEQKELHRDEKNHNLVFNAPMPLNEFRAEAKKHLESILVSIKAKNKVVTKNINKGKTKDGHQQIVQLTPRGALHNETVYGKIRNYEAEYRKVDGKFTEEVILRVSNQKCREALLNRLAEYDNNPKKAFTGKNSLEKNPIWLNADHSHAVPLKVKLYKIVDVFTIKKAVDKDLKIDKVIDNKIRAILQQRLDEFVGDAAKAFSNLDENPIWLNEEKGIAIKRVKIRGIANGEPIRVKRDIKGNIIKDENGNPIPNDYVNTGNNHHVAVFRDKEGKLQEHVVSFYEATTRAILGYPIVDKEYRHSEGWEFLFSMKQNEYFVFPNEKTGFKPQEIDLLNANNWGIISPNLYRVQKFTTGDYFFRHHLETNVESDNALRDITWKRIRSIQDLDGIVKVRLNHLGSIVTVGEY

SEQ ID NO: 8019 - protein, 1371 aa, unidentified
  REGION 1..1371: note = Description of Unknown:uncultivated organism sequence
MKKILGLDLGTTSIGWAVVNEATNKEEKSSIVKLGVRVNPLTVDEQTNFEKGKPITTNADRTLKRSMRRNLQRYKLRREHLISCLKENGFITDDSILCENGNRTTFETYRLRAKAATEEISLEELARVLLMINKKRGYKSSRKAKSNDEGELVDGMSVAKTLYEEDITPGQYSLQLLCNGKKYLPDFYQSDLRVELQKIWEKQQTFYPDILTPDFMQVLEGKSKTNTSKIFYARYGIHTADNKSKDKKRQAYEWRVDGLTRQLNIEEVAYVISDLNGLINGSSGYLGKISDRSKNLYFNKLTVGQYLMQELDKNPNVSLKNQVFYRQDYLDEFETIWNTQSQYHPELTYELKKDIGNMIIFYQRPLKSQKGLVAICELENEQREVEVDGVKKLITTGCKVCPKSSPLFQEFRMWQRLNDVIVYDSNAKADLFGNGTATKRRLTEEEMNTLAFELNIKGKLTKQQALKCLFGKATGLDMNFKELDGNETQAKLFEAYLKIVEMSGHEGYDYAKLNASQIFDVVEKVFAGLGFNTAPLYFDASIEGKQFDKQPMYQLWHLLYSYEGDNSKTGDESLVKKIRDIFHFDNDDYAKIIAGISFKPDYGSLSAKAIKKILPFMKAGNDYSLACEYAQYNHSKRSLTKEELEKKELKDHLDLLPKNSLRNPVVEKILNQMINVVNEVVKTYGPLDEIRIEMARDLKMNAKKREEKTSEINRMNAYHEDIKKILQAAPFNIEHVSRNDIIRYKLYEELKDNGYKTLYSNTYISKEKLFSREFDIEHIIPQARLFDDSFSNKTLESRSINQEKGNATAFDFVKEKYGEEGAKAYKQRIDELLKQQVLSKAKHDKLLMTIDDIPEDFIMRDLRDTQYIARKAREILEQIVKVVVPTNGKITHKLREDWQLINVMQELNAPKFQELGLTEKDWTKRNDHRHHAMDALTIAFTKLSIIQYLNNLNARSDKSSSIYGIEQKELYRDKHGHMRFLPPIPLDEFRVEAKQQLEQILVSIKSKTKVVTRNVNKSKSKKAEKGFNKRVQLTPRGQLHNETIYGSSQRYVTKEEKIGSSFDAEKIATVANKAYREALRHRLDAYDGDAKKAFTGKNSLEKAPIWLDDLHTRAVPIKVKCVTMETIYTIRKPISKDLRIEKVVDKHIQDILRVRLEEYGGDANRAFSNLDENPIWLNEEKGIRIKSVAINAGLSKPEAIHVKRNQFGKPILNERGNKQAADFVQTANNHHVAIFRDANGKLQEHIVSFYEATMRANQGWPIIDKEYNQTEGWEFLFSMKQNEYFVFPDKDFCPADYDLMNPDNYAIISPHLFRVQKLASKDYFFRHHLETTVEDKNELRDMTWKRIRNCDELQGIVKVRVNHIGQIVAVG

SEQ ID NO: 8020 - protein, 560 aa, unidentified
  REGION 1..560: note = Description of Unknown:uncultivated organism sequence
MAYLQKVEELYKAGKISKTKYNKLRMKGSDIPDGFIERDIRDTQYIAKKAKELLEKLVKRVVSTSGSITDRLREDWQLVDVMQELNWDKYDKLGQTEIIENREGHKIKRIKDWTKRNDHRHHAMDALTIAFTKHEHIQYLNNLNARSDKAGSIYAIEAKELERDERGKLKFKPPMPINEFRAEAKKHLEDTFVSIKAKNKVVTTNINVTKTGDGVRKKKQLTPRGQLHLETVYGSILRYVTKEEKVGSGFTEELIQRVAKKSHREALLKRLKEFDNDPKKAFTGKNSVDKNPIWLDDAHTRQLPEKVITVTTETVYTIRKEISPDLKLEKVVDIKIRRILEARLKEFNGDSKKAFSNLDENPIWLNKEKGIAIKRVTITGISNAEALHDKKDKEGHLILDAHGKPQPVDFVNTGNNHHVAIYRDAEGNLQENVVTFFEAASRVNLGLPIIDIGYNGDKGWQFLFSMKQNEYFVFPDEKTGFKPNEIDLLNSENYHLISPNLFRVQKLATKDYFFRHHLETTVDSDNKLKGITWLRLGINGIDNIIKVRINHLGQIVSVGE

SEQ ID NO: 8021 - protein, 828 aa, unidentified
  REGION 1..828: note = Description of Unknown:uncultivated organism sequence
MKKVLGLDLGTNSIGWAMVNEAEKNDERSEIIKLGVRVNPLTVDELQNFEKGKSITTNADRTLKRSMRRNLQRYKLRRENLIEILKENRFIKDQTILSENGNHTTFETFRLRAKAANEEVTLEQFARILLMINKKRGYKSSRKAKTQDEGQLIDGMSIAKRLYEEKLTPGQFVYQQLQEGKKYIPDFYRSDLQTELDRIWDFQKKYYPEILTNDFRQQIAGRGKLNTSKILLARYGIYTADNKGADKRLQAFKWRVDALSKQLTKEELAFVISEVNGSISNSSGYLGAISDRSKELFFNKQTVGQYLMCQLEKNPHTSLTNQVFYRQDYLDEFNTLWDCQAKFHKQLTPLLKEEIRDVIIFYQRRLKSQKGLVSVCEFENRQIEVRVEGKTKKKTIGLKVCPKSSPLFQEFKIWQILNNVQVIEKASGAKRFLDQEEKEILFFEASYKDKITKDDILKLLYKNFKELDLNYKEIEGNRTQAALFKSYQIIVEASGHGEYDFTKMPSKAVLEIVESVFNALGYNSDILKFNADLDDPEFDKQPLYRLWHLLYSFEGDNSITGHEKLVEKIAALFGFEHEYAGIIAKMSFQPDYGSLSAKAIRKILPHLKEGNAYSLACEYAGYRHSKNSLTKQELENKHLDNKLDIFPKNSLRNPVVEKILNQMINVVNSAIDVYGKPDEIRIELARELKKSAKEREELTNTINRATAEHEKIRETLKKEFGLPHVSRNDIIRYKLYLELASNGHHTLYSNTYIEPGKLFSKEFDIEHIIPQSRLFDDSFSNKTIERRSVNIEKGNDTAYDYVLAKQNQDGLMVYFKKKHQTEKREHIN

SEQ ID NO: 8022 - protein, 1334 aa, unidentified
  REGION 1..1334: note = Description of Unknown:uncultivated organism sequence
MRRNLQRYKLRREFLIKSLIRSGIITDETILSESGPSSTFETYRLRAKAACKRIELEEFARVLLMINKKRGYKSNRKIKDADSQGSTIINSIDIARKLYDEGLTPGELCKDLLKDGQKRLPDFYKSDLHDEFERIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVDGKEITIGAKVAPCSHPIFQEFKIWQVLNNLEVSLVEPVYAEAIYSNVFECFDNSFKSDESRKLEKEEKEVLARELFYKGDLSKSDVLKILFKKTKGLDLNFDRVSGNKTTHAIFSAFAEYFNGKKENTIDFKNSANEIEKHFKSAFDKYKINTDLLKIDLSKSNKEIEKEPLFRLWHLLYSYEGDNSVSGVEKLIEKLKELCNIDNDCATILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKKSTKEREDLNSAILKGNKENEAVREVLRKEFNISNPSKNDVIRYKLYQELKVNGYKTLYSNKKIDLGILFSNEIDIEHIIPQARLLDDSFSNKTLEFRDVNIEKGNRTAYDYVASKYGPEELEAYKKRCEAVCIEGKKAKLRKLMMTEADIPDGFIERDLRETQYISKKALEMLNEVFKTVTATTGSITDELRNDWQLVDLMKELNLPKYEALGEVSEIEDSKGHKKKVINDWTKRNDHRHHAVDALTVAFTKSALIQYYNYKNAAWMEGHKGHAVISAIKAKYFEGGKAKSPIPLTTFRAEVKRALESLLVSIKSKTKVVTKNKNRINRNNGPLEQNTLTPRGELHEETVRGCIKVPVWENEKIGKDFDAQKISRVADVRYRIALSNRLKEFNNDPKAAFSGKNSLTKKPINCGDGETVPQKVLVKHFENVYTVRKPVDENLNIEKVVDSRIRQLLKDRVAMFKSQKEAFADLENNPIWVNKERCIALKRVTIGEKLGNAVALHYKKNKDGKFILDKEGNKIPVDFVKTGNNHHAVIYRVPQKGKDGKLKYDKDGNLEYEIVDIVVPFYEAVRRKSEGLDVVDKNLNKEAGWEFLFSMKQNEYFVFPNEKTGFDPTKIELNDPKNYSAISPNLFRVQKFSKGDYMFRHHLETTVKNESKEMKDILYKRITSLKQFENMVKVRVNHIGEIVDVGEK

SEQ ID NO: 8023 - protein, 1320 aa, unidentified
  REGION 1..1320: note = Description of Unknown:uncultivated organism sequence
MIKSLTRSGIITDETILSESGPSSTFETYRLRAKAACERIELEEFARVLLMINKKRGYKSNRKIKDADSQGSTMINSIDVARKLYDEGLTPGELCKDLLKDGQKRLPDFYKSDLHDEFERIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVDGKEITIGAKVAPCSHPIFQEFKIWQVLNNLEVSLVEPVYAEAIYSNVYECFDNSFKSDESRKLKQEEKEVLARELFYKGDLSKSDVLKILFKKTKGLDLNFDRVSGNKTTHAIFSAFAEYFNGKKENTIDFKNSANEIEKHFKSAFDKYKINTDLLKIDLSKSNKEIEKEPLFRLWHLLYSYEGDNSVSGVEKLIEKLKELCNIDNDCATILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKKSTKEREDLNSAILKGNKENEAVREVLRKEFNISNPSKNDVIRYKLYQELKVNGYKTLYSNKKIDLGILFSNEIDIEHIIPQARLLDDSFSNKTLEFRDVNIEKGNRTAYDYVASKYGPVELEAYKKRCEAVCIEGKKAKLRKLMMTEADIPDGFIERDLRETQYISKKALEMLNEVFKTVTATTGSITDELRNDWQLVDLMKELNLPKYEALGEVSEIEDSKGHKKKVINDWTKRNDHRHHAVDALTVAFTKSALIQYYNYKNAAWMEGHKGHAVISAIKAKYFEGGKAKSPIPLTTFRAVVKRALESLLVSIKSKTKVVTKNKNRINRNNGPLEQNTLTPRGELHEETVRGCIKVPVWENEKIGEDFDAQKISRVADVRYRIALSNRLKEFNNDPKAAFSGKNSLTKKPINCGDGETVPQKVLVKHFENVYTVRKPVDENLNIEKVVDSRIRQLLKDRVAMFKSQKEAFADLENNPIWVNKERGIALKRVTIGEKLGNAVALHYKKNKDGKFILDKEGNKIPVDFVKAGNNHHAVIYRVPQKGKDGKLKYDKDGNLEYEIVDIVVPFYEAVRRKSEGLDVVDKNLNKEAGWEFLFSMKQNEYFVFPNEKTGFDPTKIELNDPKNYSAISPNLFRVQKFSKGDYMFRHHLETTVKNESKEMKDILYKRIQNAKGLIGMVKVRVNHIEEIVDDKGL

SEQ ID NO: 8024 - protein, 1400 aa, unidentified
  REGION 1..1400: note = Description of Unknown:uncultivated organism sequence
MKRILGLDLGTTSIGWALVNEAESENEISGIVKLGVRVNPLTVDEMSNFEKGKSFSINEVRRIKRGMRRNLQRYKLRREFLIKSLTRSGIITDETILSESGPSSTFETYRLRAKAACERIELEEFARVLLMINKKRGYKSNRKIKDADSQGSTMINSIDVARKLYDEGLTPGELCKDLLKDGQKRLPDFYKSDLHDEFERIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVDGKEITIGAKVAPCSHPIFQEFKIWQVLNNLEVSLVEPVYAEAIYSNVYECFDNSFKSDESRKLKQEEKEVLARELFYKGDLSKSDVLKILFKKTKGLDLNFDRVSGNKTTHAIFSAFAEYFNGKKENTIDFKNSANEIEKHFKSAFDKYKINTDLLKIDLSKSNKEIEKEPLFRLWHLLYSYEGDNSVSGVEKLIEKLKELCNIDNDCATILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKKSTKEREDLNSAILKGNKENEAVREVLRKEFNISNPSKNDVIRYKLYQELKVNGYKTLYSNKKIDLGILFSNEIDIEHIIPQARLLDDSFSNKTLEFRDVNIEKGNRTAYDYVASKYGPVELEAYKKRCEAVCIEGKKAKLRKLMMTEADIPDGFIERDLRETQYISKKALEMLNEVFKTVTATTGSITDELRNDWQLVDLMKELNLPKYEALGEVSEIEDSKGHKKKVINDWTKRNDHRHHAVDALTVAFTKSALIQYYNYKNAAWMEGHKGHAVISAIKAKYFEGGKAKSPIPLTTFRAVVKRALESLLVSIKSKTKVVTKNKNRINRNNGPLEQNTLTPRGELHEETVRGCIKVPVWENEKIGEDFDAQKISRVADVRYRIALSNRLKEFNNDPKAAFTGKNSLTKKPINCGDGETVPQKVLVKHFENVYTVRKPVDENLNIEKVVDSRIRQLLKDRVAMFKSQKEAFADLENNPIWVNKERGIALKRVTIGENLGNAVALHYKKNKDGKFILDKEGNKIPVDFVKTGNNHHAVIYRVPQKGKDGKLKYDKDGNLEYEIVDIVVPFYEAVRRKSEGLDVIDKNLNKEEGWEFLFSMKQNEYFVFPNEKTGFDPTKIELNDPKNYSAISPNLFRVQKFSKGDYMFRHHLETTVKNESKEMKDILYKRITSLKQFENMVKVRVNHIGEIVDVGEK

SEQ ID NO: 8025 - protein, 1400 aa, unidentified
  REGION 1..1400: note = Description of Unknown:uncultivated organism sequence
MKRILGLDLGTTSIGWALVNEAESENEISGIVKLGVRVNPLTVDEMSNFEKGKSFSINEVRRIKRGMRRNLQRYKLRREFLIKSLTRSGIITDETILSESGPSSTFETYRLRAKAACERIELEEFARVLLMINKKRGYKSNRKIKDADSQGSTMINSIDVARKLYDEGLTPGELCKDLLKDGQKRLPDFYKSDLHDEFERIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVDGKEITIGAKVAPCSHPIFQEFKIWQVLNNLEVSLVEPVYAEAIYSNVYECFDNSFKSDESRKLEQEEKEVLARELFYKGDLSKSDVLKILFKKTKGLDLNFDRVSGNKTTHAIFSAFAEYFNGKKENTIDFKNSANEIEKHFKSAFDKYKINTDLLKIDLSKSNKEIEKEPLFRLWHLLYSYEGDNSVSGVEKLIEKLKELCNIDNDCATILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKKSTKEREDLNSAILKGNKENEAVREVLRKEFNISNPSKNDVIRYKLYQELKVNGYKTLYSNKKIDLGILFSNEIDIEHIIPQARLLDDSFSNKTLEFRDVNIEKGNRTAYDYVASKYGPEELEAYKKRCEAVCIEGKKAKLRKLMMTEADIPDGFIERDLRETQYISKKALEMLNEVFKTVTATTGSITDELRNDWQLVDLMKELNLPKYEALGEVSEIEDSKGHKKKVINDWTKRNDHRHHAVDALTVAFTKSALIQYYNYKNAAWMEGHKGHAVISAIKAKYFEGGKAKSPIPLTTFRAEVKRALESLLVSIKSKTKVVTKNKNRINRNNGPLEQNTLTPRGELHEETVRGCIKVPVWENEKIGEDFDAQKISRVADVRYRIALSNRLKEFNNDPKAAFSGKNSLTKKPINCGDGETVPQKVLVKHFENVYTVRKPVDENLNIEKVVDSRIRQLLKDRVAMFKSQKEAFADLENNPIWVNKERGIALKRVTIGENLGNAVALHYKKNKDGKFILDKEGNKIPVDFVKTGNNHHAVIYRVPQKGKDGKLKYDKDGNLEYEIVDIVVPFYEAVRRKSEGLDVIDKNLNKEEGWEFLFSMKQNEYFVFPNEKTGFDPTKIELNDPKNYSAISPNLFRVQKFSKGDYMFRHHLETTVKNESKEMKDILYKRITSLKQFENMVKVRVNHIGEIVDVGEK

SEQ ID NO: 8026 - protein, 1400 aa, unidentified
  REGION 1..1400: note = Description of Unknown:uncultivated organism sequence
MKRILGLDLGTTSIGWALVNEAESEKEISSIVKLGVRVNPLTVDEMSNFEKGKSFSINEVRRIKRGMRRNLQRYKLRREFLIKSLIRSGIITDETILSESRPSSTFETYRLRAKAACERIELEEFARVLLMINKKRGYKSNRKIKDADSQGSTMINSIDVARKLYDEGLTPGELCKDLLKDGQKRLPDFYKSDLHDEFARIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVNGKEITIGAKVAPCSHPIFQEFKIWQVLNNLEVSLVEPVYAEAIYSNVFECFDNSFKSDESRKLEQEEKEVLARELFYKGDLSKSDVLKILFKKTKGLDLNFDKVSGNKTTHAIFSAFAEYFNGKKENTIDFKNSANEIEKHFKSAFDKYKINTDLLKIDLSKSNKEIEKESLFRLWHLLYSYEGDNSVSGVEKLIEKLKELCNIDNDCATILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKKSTKEREDLNSAILKGNKENEAVREVLRKEFNISNPSKNDVIRYKLYQELKVNGYKTLYSNKKIDLGILFSNEIDIEHIIPQARLLDDSFSNKTLEFRDVNIEKGNRTAYDYVSSKYGPEELEAYKQRCEEVCRDGKKAKFRKLMMTEAEIPDGFIERDLRETQYISKKALEMLNEAFKTVTATTGSITDELRNDWQLVDLMKELNLPKYEALGEVREIEDSKGHKKKVINDWTKRNDHRHHAVDALTVAFTKSALIQYYNYKNAAWMEGHKGHAVISAIKAKYFEGGKAKSPIPLTTFRAVVKRALESLLVSIKSKTKVVTKNKNRINRNNGPLEQNTLTPRGELHEETVRGRIKVPVWENEKIGEDFDAEKISRVADVRYRIALSNRLKEFNNDPKAAFTGKNSLTKKPINCRDGETVPQKVLVKHFEDVCTVRKPVDENLNIEKVVDSRIRQLLKDRVAMFKSQKEAFADLESNPIWVNKERGIALKRVTIGEKLGNAVALHYKKNKDGKFILDKEGNKIPVDFVKTGNNHHAVIYRVPQKGKDGKLKYDKDGNIEYEIVDIVVPFYEAVRRKSEGLDVIDKNLNKEEGWEFLFSMKQNEYFVFPNEETGFDPTKIDLKDPKNYSVISPNLFRVQKFSKGDYMFRHHLETTVKNESKEMKDILYKRIKSLKQFENMVKVRVNHIGEIVDDKGL

SEQ ID NO: 8027 - protein, 1400 aa, unidentified
  REGION 1..1400: note = Description of Unknown:uncultivated organism sequence
MKRILGLDLGTTSIGWALVNEAESEKEISSIVKLGVRVNPLTVDEMSNFEKGKSFSINEVRRIKRGMRRNLQRYKLRREFLIKSLIRSGIITDETILSESRPSSTFETYRLRAKAACERIELEEFARVLLMINKKRGYKSNRKIKDADSQGSTMINSIDVARKLYDEGLTPGELCKDLLKDGQKRLPDFYKSDLHDEFARIWQKQKAFYPEILTDEAYEEMLKSNKVYDVLSNFAKYEITKPKKKEPLLQIYSNRVASLTKQISIEDLASVISSLKVQINKANGYLGNISDRSKILHINNITVGQFLLDKINNNPSASIKNNVFYRQDYLDEFEVIWEQQAKYHAVLTPELKEEIRDIIIFYQRKLKSQKGSVGFCEFESSKKIVNGKEITIGAKVAPCSHPIFQEFKIWQVLNNLEVSLVEPVYAEAIYSNVFECFDNSFKSGESRKLEQEEKEVLARELFYKGDLSKSDVLKILFKKTKGLDLNFDKVSGNKTTHAIFSAFAEYFNGKKENTIDFKNSANEIEKHFKSAFDKYKINTDLLKIDLSKSNKEIEKESLFRLWHLLYSYEGDNSVSGVEKLIEKLKELCNIDNDCATILANVTFENDYGNLSVKAMNKILPFMKEGERYDLACAEAGYRHSKSSLTKEEIENKVLKDKLSLLPKNSLRNPVVEKILNQMVNVVNSVIDTYGKPDEIRVELARELKKSTKEREDLNSAILKGNKENEAVREVLRKEFNISNPSKNDVIRYKLYQELKVNGYKTLYSYKKIDLGILFSNEIDIEHIIPQARLLDDSFSNKTLEFRDVNIEKGNRTAYDYVSSKYGPEELEAYKQRCEEVCRDGKKAKFRKLMMTEAEIPDGFIERDLRETQYISKKALEMLNEAFKTVTATTGSITDELRNDWQLVDLMKELNLPKYEALGEVREIEDSKGHKKKVINDWTKRNDHRHHAVDALTVAFTKSALIQYYNYKNAAWMEGHKGHAVISAIKAKYFEGGKAKSPIPLTTFRAVVKRALESLLVSIKSKTKVVTKNKNRINRNNGPLEQNTLTPRGELHEETVRGRIKVPVWENEKIGEDFDAEKISRVADVRYRIALSNRLKEFNNDPKAAFTGKNSLTKKPINCRDGETVPQKVLVKHFEDVYTVRKPVDENLNIEKVVDSRIRQLLKDRVAMFKSQKEAFADLESNPIWVNKERGIALKRVTIGEKLGNAVALHYKKNKDGKFILDKEGNKIPVDFVKTGNNHHAVIYRVPQKGKDGKLKYDKDGNIEYEIVDIVVPFYEAVRRKSEGLDVIDKNLNKEEGWEFLFSMKQNEYFVFPNEETGFDPTKIDLKDPKNYSVISPNLFRVQKFSKGDYMFRHHLETTVKNESKEMKDILYKRIKSLKQFENMVKVRVNHIGEIVDDKGL

SEQ ID NO: 8028 - protein, 1327 aa, unidentified
  REGION 1..1327: note = Description of Unknown:uncultivated organism sequence
MGKNYYIGIDMGTDSVGWAVTDEEYRLLKSKGRDLWGSYLFEEAQAAAQRRSFRTARRRTARTRQRLLLLQSLFAEEMAKVDPLFFLRLNNSSLFLQDKDGKLRCSDALFGDPSYRDKDYFAEYPTIYHLRAALLQGEVKDIRLLYLAIHHILKNRGHFLFESQSFSVGDTQTVRDKFTAINAFLSDREMPTLELSALSEGLEVLRNSRIGKRDKQLRLKDIFKTGGEKSLIALVKALTGGSVNLKELYCAEESFADVSVFSFEKASFDETDLPAIENAVGQEEAELVLLLKSVYDWSVLCAIMWEEQFISRAKKRIYEKHKADLCRLKEYIRKNCPEKYADVFRRREKKSNYAAYIGMDKQKGCAKCKRGDFYAFLKKEIKIEDEYILTEIEKGEFLPKQVSDANGVIPYQVHLLELKAILANAAGKFPFLTDERDGSTVAEKIISLMTFRIPYYVGPLHTQSPFAWAVRKSGYERTSVTPWNFDSVIDADASEEQFIRRMTNKCTYLAGQDVLPANSLLYSEFTFLNELNNLRVNGVKNDAARKLIYEYAKQHKKVTLKNCLALLVREGLLPVGSRAEETFSGIDGDFKTSLAPWYDLRFLGNKIETHREMCEEIIIWITLISDKERLEKRIRRAYGTILSDEEIKRFKGLNYSKWGRLSAVLLDGIVSPRCADENGEPLTIIRAMRATGENFMQLLSAKYGYQEAIDAYNAENAPRGKVTYKTVEDLYCSPSVKRAIWRTVELVREIAKICGGAPKKLFIETVREVNDDRRGQRTVFRKQQLIDLYKNIKKEERDWIAEIENTADKKFDSDRLVLYYRQLGRSMYSQKPIRLEDVFDTNICDIDHIYPQSKIKDDSLDNRVLVFKTENTAKGDRYPLSADVREKMISFWRELKDRALIGEKKFERLTRTTALTQEELADFINRQLVSTSQSTKAAAQILGEIFPDTEIVYAKAGNANRFKDENKIVKVRELNDLHHAKDAYVNIVVGNVYNTKFNHNAAVYFRDHGVDSYNLKNLFTHDIPGAWKVSEKERILQTVAKNTCRVVRMTENGKGKLFDIQPKSAGKNADLIPLKICGAISDTAKYGGYDSATTAYFMLVRSKGKKGKVALSLEAYPLWLDKRSSAKEDKLKFCTERIGLKDPEIIFDNIKLNTLFCIDGSYAWLRGITGKQLIWRNANELFLDEESMRTLKNISNYMRDRKRLNKPDLRAGDKITAEGNIRLYDALVEKLGSSVYAGLSVKGQEPFLRGKREAFAELSREDQCKIIFEVLHLMQCNSVLSDFSSLGGVAHAGKNFSNKFVQDMDIKMIFQSPTGYYRRVVDLKEFV

SEQ ID NO: 8029 - protein, 1342 aa, unidentified
  REGION 1..1342: note = Description of Unknown:uncultivated organism sequence
MDKKYYIGFDIGTESIGWATTDTEYNLLKTRGQDFWGVYLFDEAKTSETRRASRTSRRRTARRRQRIKLLQELFAQEIAKTDFCFFERLNNSKYNVKDKNDGVAYRDCLFHDEAFGDKEYFKNYPTIYHLRAAFLDAQRAKKIKDVRLLYLAVAHIIKNRGHFLFEGQQFSVGNKDVVLAAFSAINEILTSIDENAKTLSLANVDETLKTLCGGKLTKSDKERRLKLLLETENDKTCNAIIKAIVGLQVNVKNLFGDEEPQIKNFCFDDAGFEIEKLKDAFDEDEYALICEAKAIYDWAVLSQILKNHKYLSEAMCEIYDAHAADLELLKTYVKENFGQEKYREVFRLCKNVNNYAAYVGKDRNRSFCHVSKDDFYKYLRSFVTDEEILKRMDEGSFLQKQRSNANGVIPYQVQFAELERILDNASENFPFLNDVSDGLSVKEKIRSLLTFRIPYYVGPLNTAHIDKGFAWVKKYDDAENVKITPWNFDKVVDKQASEDEFIKRMTSKCTYLVGEDVLPKQSLLYSEFTFLNELNNVTFKGRRLDKQAREVIVEYAKNNNRKITLKVIADVLAKAGLIEQSEKAKENFAGIDGEIKSGFSTLRFFKRLFGDNFNREQCETIVKWFTVMGNKSDAAERAKRAFKFDEATTKQLKGLNCSGWGRLSKEFLDGSEITTVDENGEILTIIQAMRETGCNLMELMSSKFGFESSVNKFNDQYAGDKKVTYKTIEDLYCSPSVKRAIWRTVCLAREIEKVQRCAPSRIFIEMARGEDKGKKGARTKSRKEQLLELYKACKSDVLQWVTQEFIDALENVEDTKLLSDKLYLYYIQMGRCAYTGRPISIEEVFNTNVCDIDHIYPQSKIKDDSIINNKVLCYKTANAAKGDGYPVAYEIREKMLPIWTVWYNKKFISDEKFKRLMRSTPLAVDELTDFINRQLVETQQSTKAVAQILKRMYPNADVVYSKARNVVDFKNRINKNRPVLVKVREINDLHHAKDAYLNVVVGNVYYTKFNRNAAIFFQNNNADSYNMNRLFEENVKNAWNPSYKQKVVSVANRNICKVVRFTSEGEGKLFDATVKTKGANDKLIPLKRNCPLENTADYGGYDNATTAYFSLVRSVGKKGKTQLSIEAIPVYVDLLGKDRVFDYLKNTVGLEQPQILIEKIKINSLLKLNGAYVWLRGKTNDSLTICNANQMVLDSEMTAYVKRIVSYNEKRKNNKDAKVDETYDKISKTGNLTLYNALLDKLTSHPYINFSALQKQAEFLKEKRDVFCELSVENQCTLLLEILHLMQCNSTSSNLTLIGGGSRAGVLTCNKKLPETGECLLITQSPTGYYKNIVNLTAYYRQ

SEQ ID NO: 8030 - protein, 1344 aa, unidentified
  REGION 1..1344: note = Description of Unknown:uncultivated organism sequence
MDKKYYIGFDIGTESIGWATTDVEYNLLRARGQDFWGVYLFDEAKTAEVRRSNRTSRRRTARRRQRIKLLQELFAQEIAKVDFCFFERLNNSKYYVKDKSDSVSYRDCLFHDEAFTDKEYFKKYPTIYHLRAALVDKKQAKEITDIRLLYLAVAHIIKNRGHFLFEGQQFSVGNKDIVLDAFSKINEILTTLDENAKTLSLSDIDKTLEVLCDNKHTKSDRERQLKILFETENDKACGAIIKAIVGLQVNVKNLFGEEDPQIKSFCFDDAGFEIEKLKDAFDEDEYSLICEAKAIYDWAVLSQILGNFEYLSQAMCAKYDAHHEDLKLLKAYLKENFGKEKYDEVFRKRKDVNNYAAYVGKDRNKSFGHVSKDEFYKYLRSFVKNEEILKRMEEGVFLEKQRSNANGVIPYQVQLAEVKQILDNASDNFPFLNYESDGMSIKEKICSLLTFRIPYYVGPLNTAHQEKGFAWVKKYDGTGNVKITPWNFDAVVDRQASEDEFINRMTNKCTYLLGEDVLPKQSLLYSEFAFLNELNNVTFMGRRLDKQARDAVLDFAKANNRKITIKVIADVLAKAGLIEQSEKETENFAGIDGEIKSSFSTLRFFKRLFGDDFNVDMCETIVKWFTIMGNKTDAAERAKREFKLDDETAKQLKGLNCSGWGRLSKEFLDGEEITVTDGNGEILTIIQAMRETGCNLMELMSAKYGFRDAVDKYNAQYSGDGKVTYKTVEDLYCSPAVKRAIWRTVCLAKEIEKVQRCAPSRIFIEMARGEDRDKKGVRTKSRKEQLLELYKACKSDVSQWVTQEFIDRLENTEDAKLLSDKLYLYYIQMGRCAYTGKAISLEEVFNTNICDIDHIYPQSKIKDDSIINNKVLCYKTSNSTKSDDYPIAHEIREKMLPIWSVWHNKNFISDEKFKRLTRSTPLTADELADFINRQLVETRQSTKAVAQILKQLYPNADIVYSKASNVVDFKNRVNKNRQIPAIVKVREINDLHHAKDAYLNIVVGNVYYTKFNRNAAIYFKNNNIDSYNMKRLFEDSLKNAWEPSYKQKVVSTVNKNICKVVRFTSEGEGKLFDATIKTKGTNDKLIPLKRNCPLEDIAKYGGYDNATTAYFSLVRSVGKKGKMQLTLEAIPVYVDLLGKDRVFDYLKNIVGLEQPQILIEKIKINSLLKLNGTYVWLRGKSCDKITICNANQLVLDTSIVAYAKHIVSFIDKKENNKGAKVDVVYDKIDKTGNLMLYNTLLQKLQSQPYINLSALKTQIDFLEGKRDSFNMLSLEEQCSLLLEIMHLFQCNSTPANLKLIDGVSRAGVLTCNKKLSETGECLLITQSPTGYYKNIVNLTAFYQQ

SEQ ID NO: 8031 - protein, 1343 aa, unidentified
  REGION 1..1343: note = Description of Unknown:uncultivated organism sequence
MRENYYVGLDIGTDSVGWAVTDPEYKLLRGKGKDMWGAYLFDPAKTAADRRGYRTARRRTARVRQRIKLLQELFAAEVYAVDPAFFIRMDQSKFVESDKTIDGKDAIFHDESFGDKEFYKKFPTIYHLRAAFLDPQQARDITDVRLLYLAVHHIIKNRGHFLFEGQNISAGDTGLLQENFSAINAYLSDNDQRTLPPGKYAGIADILKDRKAGKNAREAQLKAVCDVDKADKTALAAIRCFVGKKVDLKDLFGENHVAAKEKLCFDDVNFDKNYDTLRAQLTDEEAAFVDAMKAVYDWAMLAEVLDGNTYLSLAMIERYRRHAEHLKMLKEYIKAECPEKYVQTFRRNASNNYAAYVGSDRGKGFKHCTREDFYKYLRSFVKDEQILSLIERGEFLPKLRTSVNGVIPYQVHRAELVAILKNAEANFPFLKEEQDGFTVAEKIIKLFEFRIPYYVGPLSSAHESKNPKKGFYWAVKNPGFETTKITPWNFDKIIDRDASEDKFIGRKTSKCTYLLGEDVLPKSSLLYSEFTFRNELNNLCFKGNRLSEDAREEIFKYASEHKRVTLSGIGKLLENNNLIECGEGKPENFSGTDGDFHSSLSSLITMKNVLGEYFDRDMAEQIILWATVTPDKDRLVRRVKNNYSLPEDVLKRIKGLTFGGWGRLSEKFLTDIWAADDDGVRTNIIGAMKSTGANLMELLSAKYGFSDAVNAFNADNTPSSAVGYQDVDELYCSPSVKRAIWRTICLVREIEKINGCPPKRIFVEMARGATEDQKGKRTTSRKEQIKALFKDIRDNERDWMAEIENQPDSVFSSDKMFMYYMQMGKCAYSGENIPLNEVFNTNIYDIDHIYPQSKIKDDSLDNRVLCRKEYNQHIKKDVYPVSKEIRDKMRDIWAVWLDKKLISKEKYKRLTRSTPLTEAELSDFINRQLVETRQSTKAVSTLLKRMYPDSEIVYSKAGNVAAFKEKVNNDYKKHDKPELSIVKIRELNDLHHAKDAYLNIVVGNVYFTKFNCNAAIFFKKNGIDSYNLNRLFDCDLHGAWKVSEKERILQTARKNTCRVVRFVSEGRGGLFNATIKPKGANDNLIPLKANGPLADTSKYGGYDSASTAYFALVSSTGKKNEKTITLEAIPIYIDLLGENAVRDYIYKTTADQKAQILIDKIKTKSLLKIDGAYCYLTGKTNESLTVCNANQFIISDEDAAYLKKISRFCEKNKKAEGRLTADDKHDGISKEKNLSFYRMLTSRLCTKPYVVLSIGKQAKKLRRFEPVFVELEAEKQCSVIMEIMHFFQCKSGTGDLSVLGGGKTLGVNTHSKTIDPDEEILLISQSPTGFYQNAISLTGFYKA

SEQ ID NO: 8032 - protein, 1366 aa, unidentified
  REGION 1..1366: note = Description of Unknown:uncultivated organism sequence
MVVKHLSKHIITYKRELSIQMKKIYYLGFDIGTESIGWATTDSEYNLLKARGHDYWGTYLFDEAKTAEKRRLNRTSRRRVARRRQRIKLLQEIFAEEIAKKDFCFFERLNNSKYNVEDKAENVKYRDSLFHDEIFNDKEYFKKYPTVYHLRRAFLNTQSASEIKDIRLLYLAVAHIVKNRGHFLFEGQEFNAGDKNLAETAFERINLSLKEIDEDKQALSLAKIDDVFSVLLDKKKNKRDKVGEIKQLLDVNKDKTCQEIVNAIVGCKVKVANLFDDTESELKDFCFDDANFELEKLQSMLSEEEYNVVCNMKTVYDWAVLSKILGNYRYVSEAMCAKYDSHKEDLRLLKEYVKREFGQDKYKEVFRKQEKVNNYAAYVGSDRNKSFAHASKDDFYKYLKSFVKDEEILKRIEDGTFLEKQRTNANGVIPYQVHKAELERILENASVNFPFLNEISDDVKIKDKIVMLLTFRIPYYVGPLNDLHAEKKFAWVKKYDGMKNVKITPWNFDKVVDKHASEDAFIDRMTNKCTYLIGEDVLPKQSLLYSEFAFLNELNNVTFKGQRLDKTARDAIVAFAKSQRCKITLKVIGKTLEKEGLIEKGEGVAENFAGIDGEIKSSFSTYRFFNSLFGNNMDTDMCEEIIKWFTVMGDASRAAERTQRKYKLSAEQTKKLKDLNCVGWGRLSRRFLDSEDIVTVTEDGELLTIIEAMRETGCNLMELMSKKYGFSNAVDRYNSEFICEDGVSYKTIENLYCSPSVKRAIWRTVCLAKEIEKVQGCPPKRVFIEMARGEDKDKKRTKSRKQQLLELYRSCKADVRDWITQNEISDLTGQIESTDDARFLSDKLYLYYMQMGRSAYSGKSIDIEDLFGKNICDIDHIYPQSKIKDDSIINNKVLCYKTENSTKQDIYPIAADIRKNMLSIWSLWHDKGLIGDEKLKRLTRYTALTQEELSDFINRQLVETRQSTKAVAQILKRLYPDADIVYSKASNVVDFKNHINKDSDNPLIVKVRELNDLHHAKDAYLNIVVGNVYYTKFNRDASVYFKNNGIDSYNMSKLFDGNVKNAWMPSMKEKIVTVVNKNTCRVVRFTSEGKGELFNATIKSKGANGKLIPLKRNCPLENIAKYGGYDNATTAYFALVRSIDKKGKMQLSIEAIPIYVDMLGKENVFDYLKNCVSLTNPQILIDNIKINSLLKLNGAYVWLRGKTNNSLTICNANQLILDRETAIYSKRIVSYLEKRKKNKAIEIDERYDKIDRKGNQMLYNTLVEKLMSRPYANISTLRKQSDFLVEKRDTFESLTLEEQCIVLNEILHLMQCNSALSNFELLKGVSKAGSLTCNKKLSANDECLLITQSPTGYYKDVKNLTSFYKQ

SEQ ID NO: 8033 - protein, 1346 aa, unidentified
  REGION 1..1346: note = Description of Unknown:uncultivated organism sequence
MKKIYYLGFDIGTESIGWATTDSEYNLLKARGHDYWGTYLFDEAKTAEKRRLNRTSRRRVARRRQRIKLLQEIFAEEIAKKDFCFFERLNNSKYNVEDKAENVKYRDSLFHDEIFNDKEYFKKYPTVYHLRRAFLNTQSASEIKDIRLLYLAVAHIVKNRGHFLFEGQEFNAGDKNLAETAFERINLSLKEIDEDKQALSLAKIDDVFSVLLDKKKNKRDKVGEIKQLLDVNKDKTCQEIVNAIVGCKVKVANLFDDTESELKDFCFDDANFELEKLQSMLSEEEYNVVCNMKTVYDWAVLSKILGNYRYVSEAMCAKYDSHKEDLRLLKEYVKREFGQDKYKEVFRKQEKVNNYAAYVGSDRNKSFAHASKDDFYKYLKSFVKDEEILKRIEDGTFLEKQRTNANGVIPYQVHKAELERILENASVNFPFLNEISDDVKIKDKIVMLLTFRIPYYVGPLNDLHAEKKFAWVKKYDGMKNVKITPWNFDKVVDKHASEDAFIDRMTNKCTYLIGEDVLPKQSLLYSEFAFLNELNNVTFKGQRLDKTARDAIVAFAKSQRCKITLKVIGKTLEKEGLIEKGEGVAENFAGIDGEIKSSFSTYRFFNSLFGNNMDTDMCEEIIKWFTVMGDASRAAERTQRKYKLSAEQTKKLKDLNCVGWGRLSRRFLDSEDIVTVTEDGELLTIIEAMRETGCNLMELMSKKYGFSNAVDRYNSEFICEDGVSYKTIENLYCSPSVKRAIWRTVCLAKEIEKVQGCPPKRVFIEMARGEDKDKKRTKSRKQQLLELYRSCKADVRDWITQNEISDLTGQIESTDDARFLSDKLYLYYMQMGRSAYSGKSIDIEDLFGKNICDIDHIYPQSKIKDDSIINNKVLCYKTENSTKQDIYPIAADIRKNMLPIWSLWHDKGLIGDEKFKRLTRYTALTQEELSDFINRQLVETRQSTKAVAQILKRLYPDADIVYSKASNVVDFKNHINKDSDNPLIVKVRELNDLHHAKDAYLNIVVGNVYYTKFNKDASVYFKNNGIDSYNMSKLFDGNVKNAWMPSMKEKIVTVVNKNTCRVVRFTSEGKGELFNATIKSKGANGKLIPLKRNCPLENIAKYGGYDNATTAYFALVRSIDKKGKMQLSIEAIPIYVDMLGKENVFDYLKNCVSLTNPQILIDNIKINSLLKLNGAYVWLRGKTNNSLTICNANQLILDRETAIYSKRIVSYLEKRKKNKAIEIDERYDKIDRKGNQMLYNTLVEKLMSRPYANISTLRKQSDFLVEKRDTFESLTLEEQCIVLNEILHLMQCNSALSNFELLKGVSKAGSLTCNKKLSANDECLLITQSPTGYYKDVKNLTSFYKQ

SEQ ID NO: 8034 - protein, 1342 aa, unidentified
  REGION 1..1342: note = Description of Unknown:uncultivated organism sequence
MDKKYYIGFDIGTESIGWATTDTEYNLLKTRGQDFWGVYLFDEAKTSETRRASRTSRRRTARRRQRIKLLQELFAQEIAKTDFCFFERLNNSKYNVKDKNDGVAYRDCLFHDEAFGDKEYFKNYPTIYHLRAAFLDAQRAKEIKDVRLLYLAVAHIIKNRGHFLFEGQQFSVGNKDVVLAAFSAINEILTSIDENAKTLSLANVDETLKTLCGGKLTKSDKERRLKLLLETENDKTCNAIIKAIVGLQVNVKNLFGDEEPQIKNFCFDDAGFETEKLKDAFDEDEYALICEAKAIYDWAVLSQILKNHKYLSEAMCEIYDAHAADLELLKTYVKENFGQEKYREVFRLCKNVNNYAAYVGKDRNRSFCHVSKDDFYKYLRSFVTDEEILKRMDEGSFLQKQRSNANGVIPYQVQLAELERILDNASENFPFLNDVSDGLSVKEKIRSLLSFRIPYYVGPLNTAHIDKGFAWVKKYDGAENVKITPWNFEKVVDKQASEDEFINRMTSKCTYLVGEDVLPKQSLLYSEFTFLNELNNVTFKGRRLDKQAREVIVEYAKNNNRKITLKVIADVLAKAGLIEQSEKAKENFAGIDGEIKSSFSTLRFFKRLFGDNFNREQCETIVRWFTVMGNKSDAAERAKRAFKFDEATTKQLKGLNCSGWGRLSKEFLDGSEITTVDENGEILTIIQAMRETGCNLMELMSSKFGFESSVNKFNDQYAGDKKVTYKTIEDLYCSPSVKRAIWRTVCLVREIEKVQRCAPSRIFIEMARGEDKSKKGARTKSRKEQLLELYKACKTDVLQWVTQEFIDALENVEDTKLLSDKLYLYYIQMGRCAYTGRPISIEEVFNTNVCDIDHIYPQSKIKDDSIINNKVLCYKTANAAKGDGYPVAYEIREKMLPIWTVWYNKKFISDEKFKRLTRSTPLGIDELADFINRQLVETQQSTKAVAQILKRMYPDADVVYSKARNVVDFKNRINKNRPVLVKVREINDLHHAKDAYLNVVVGNVYYTKFNRNAAIFFQNNNADSYNMNRLFEENVKNAWNPSYKQKVVSVANRNICKVVRFTSEGEGKLFDATVKTKGANDKLIPLKRNCPLENTADYGGYDNATTAYFSLVRSVGKKGKTKLSIEAIPVYVDLLGKDKVYDYLKNAVGLEQPQILIEKIKINSLLKLNGAYVWLRGKTNDSLTICNANQLVLDSEMTAYVKRIVSYNEKRKNNKDSKVDETYDKISKTGNLTLYNALLDKLTSHPYINFSALQKQAEFLKEKRDVFCELSVENQCAVLLEILHLMQCNSAMSNFSLLSGNPTVGKLTCNKKLSETGECLLITQSPTGYYKNIVNLTAYYRQ

SEQ ID NO: 8035 - protein, 1342 aa, unidentified
  REGION 1..1342: note = Description of Unknown:uncultivated organism sequence
MDKKYYIGFDIGTESIGWATTDTEYNLLKTRGQDFWGVYLFDEAKTSETRRASRTSRRRTARRRQRIKLLQELFAQEIAKTDFCFFERLNNSKYNVKDKNDGVAYRDCLFHDEAFGDKEYFKNYPTIYHLRAAFLDAQRAKEIKDVRLLYLAVAHIIKNRGHFLFEGQQFSVGNKDVVLAAFSAINEILTSIDENAKTLSLANVDETLKTLCGGKLTKSDKERRLKLLLETENDKTCNAIIKAIVGLQVNVKNLFGDEEPQIKNFCFDDAGFETEKLKDAFDEDEYALICEAKAIYDWAVLSQILKNHKYLSEAMCEIYDAHAADLELLKTYVKENFGQEKYREVFRLCKNVNNYAAYVGKDRNRSFCHVSKDDFYKYLRSFVTDEEILKRMDEGSFLQKQRSNANGVIPYQVQLAELKRILDNASENFPFLNDVSDGLSVKEKIRSLFTFRIPYYVGPLNTAHIDKGFAWVKKYDGAENVKITPWNFDKVVDKQASEDEFIKRMTSKCTYLVGEDVLPKQSLLYSEFAFLNELNNVTFKGRRLDKQAREVIVEYAKNNNRKITVKVIADVLAKAGLIEQSEKAKENFAGIDGEIKSGFSTLRFFKRLFGDNFNREQCETIVRWFTVMGDKSDAAERAKRAFKFDEATTKQLKGLNCSGWGRLSKEFLDGSEITTVDENGEILTIIQAMRETGCNLMELMSSKFGFESSVNKFNDQYAGDKKVTYKTIEDLYCSPSVKRAIWRTVCLVREIEKVQRCAPSRIFIEMARGEDKSKKGARTKSRKEQLLELYKACKTDVLQWVTQEFIDALENVEDTKLLSDKLYLYYIQMGRCAYTGRPISIEEVFNTNVCDIDHIYPQSKIKDDSIINNKVLCYKTANAAKGDGYPVAYEIREKMLPIWTVWYNKKFISDEKFKRLTRSTPLGIDELADFINRQLVETQQSTKAVAQILKRMYPDADVVYSKARNVVDFKNRINKNRPVLVKVREINDLHHAKDAYLNVVVGNVYYTKFNRNAAIFFQNNNADSYNMNRLFEENVKNAWNPSYKQKVVSVANRNICKVVRFTSEGEGKLFDATVKTKGANDKLIPLKRNCPLENTADYGGYDNATTAYFSLVRSVGKKGKTKLSIEAIPVYVDLLGKDKVSDYLKNTVGLEQPQILIEKIKINSLLKLNGAYVWLRGKTNDSLTICNANQLVLDSEMTAYVKRIVSYNEKRKNNKDSKVDETYDKISKTGNLTLYNALLDKLTSHPYINFSALQKQAEFLKEKRDVFCELSVENQCAVLLEILHLMQCNSAMSNFSLLSGNPTVGKLTCNKKLSETGECLLITQSPTGYYKNIVNLTAYYRQ

SEQ ID NO: 8036 - protein, 1344 aa, unidentified
  REGION 1..1344: note = Description of Unknown:uncultivated organism sequence
MDKNYYIGFDIGTDSIGWATTDVEYNLLKARGQDFWGVYLFDEAQTAESRRANRTSRRRTARKRQRIKLLQELFAQEIAKVDFCFFERLNNSKYYVKDKNDNVSYRDCLFHDEAFTDKDYFKKYHTIYHLRAALVDKQQSKEITDIRLLYLAVAHIIKNRGHFLFEGQQFSVGNKDIVLDAFSKINEILTTLDENAKTLSLSDIDKALEVLCDNKHTKSDRERQLKLLFETDNDKTCGAIIKAIVGLQVNVKNLFGEGDPQIKSFCFDDAGFEIEKLKDAFNEDEYSLICEAKAIYDWAVLSQILGNFEYLSQAMCAKYDAHNDDLKLLKTYVRETFGKEKYDEVFRKRQNINNYAAYVGKDRNKAFSHVSKDEFYKYLRTFVKDESILKRMEEGVFLEKQRSNANGVIPYQVQLAELKQILGNASEHFTFLNYVSGGMSIKEKICSLLTFRIPYYVGPLNTAHSDKGFAWVKKYDGMENVKITPWNFDAVVDRQASEDEFINRMTSKCTYLLGEDVLPKQSLLYSEFAFLNELNNVTFKGRRLDKQARDSILEFAKANNKKITVKVIADVLAKAGLIEQNEKAKENFAGVDGEIKSGFSTLRFFKRLFGDDFDTDMCETIVKWFTVMGDKSDAAERAKRKYGLDNETTKQLKGLNCSGWGRLSKEFLDGNEITTIDENGEILTIIQAMRATGCNLMELMSAKFGFVDAVNRFNAQYSDTDKVTYKTVEDLYCSPSVKRAIWRTVCLAKEIEKVQHCAPSRIFIEMARGADKSKKGVRTKSRKEQLLELYKTCKSDVSQWVSQEFIDKLENTEDAKLLSDKLYLYYIQMGRCAYTGKAISLEEVFNTNVCDIDHIYPQSKIKDDSIINNKVLCYKTSNSTKSDDYPIAHDIREKMLPIWTVWYNKQFIGAEKFKRLTRSTPLTTDELADFINRQLVETRQSTKAVAQILKKLYPNADIVYSKASNVVDFKNRVNKNRQIPAIVKVREINDLHHAKDAYLNIVVGNVYYTKFNRNAAIYFKNNNIDSYNMKRLFEDSLKNAWEPSYKQKVVATVNRNICKVVRFTSEGEGKLFDATIKTKGTNDKLIPLKRNCPLENISKYGGYDKATTAYFSLVRSVDKKGKIQLTIEAIPVYVDLLGKDRIFDYLKNTVGLTQPQILVEKIKINSLLKLNGAYVWLRGKTNNQLTICNANQLVLDTNIVAYAKNVVSFLDKKKKNKDARVDVVYDKIDKTGNLMLYNALLQKLQTQPYINLSALKAQIGFLEESRCNFEILSIEEQCTLLSEVLHLLQCNSTFANLKLLGGVPSAGVLTCNKKLSETGECLLITQSPTGYYKNIVNLTAFYQQ

SEQ ID NO: 8037 - protein, 1342 aa, unidentified
  REGION 1..1342: note = Description of Unknown:uncultivated organism sequence
MDKKYYIGFDIGTESIGWATTDTEYNLLKTRGQDFWGVYLFDEAKTSETRRASRTSRRRTARRRQRIKLLQELFAQEIAKTDFCFFERLNNSKYNVKDKNDGVAYRDCLFHDEAFGDKEYFKNYPTIYHLRAAFLDAQRAKEIKDVRLLYLAVAHIIKNRGHFLFEGQQFSVGNKDVVLAAFSAINEILTSIDENAKTLSLANVDETLKTLCGGKLTKSDKERRLKLLLETENDKTCNAIIKAIVGLQVNVKNLFGDEEPQIKNFCFDDAGFETEKLKDAFDEDEYALICEAKAIYDWAVLSQILKNHKYLSEAMCEIYDAHAADLELLKTYVKENFGQEKYREVFRLCKNVNNYAAYVGKDRNRSFCHVSKDDFYKYLRSFVTDEEILKRMDEGSFLQKQRSNANGVIPYQVQLAELKRILDNASENFPFLNDVSDGLSVKEKIRSLFTFRIPYYVGPLNTAHIDKGFAWVKKYDGAENVKITPWNFDKVVDKQASEDEFIKRMTSKCTYLVGEDVLPKQSLLYSEFAFLNELNNVTFKGRRLDKQAREVIVEYAKNNNRKITVKVIADVLAKAGLIEQSEKAKENFAGIDGEIKSGFSTLRFFKRLFGDNFNREQCETIVRWFTVMGDKSDAAERAKRAFKFDEATTKQLKGLNCSGWGRLSKEFLDGSEITTVDENGEILTIIQAMRETGCNLMELMSSKFGFESSVNKFNDQYAGDKKVTYKTIEDLYCSPSVKRAIWRTVCLVREIEKVQRCAPSRIFIEMARGEDKSKKGARTKSRKEQLLELYKACKTDVLQWVTQEFIDALENVEDTKLLSDKLYLYYIQMGRCAYTGKPISIEEVFNTNVCDIDHIYPQSKIKDDSIINNKVLCYKTANAAKGDGYPVAYEIREKMLPIWTIWYNKKFISDEKFKRLTRSTPLGVDELADFINRQLVETQQSTKAVAQILKRMYPNADVVYSKARNVVDFKNRINKNRPVLVKVREINDLHHAKDAYLNIVVGNVYYTKFNRNAAIFFQNNNADSYNMNRLFEENIKNAWNPSYKQKVVSVANRNICKVVRFTSEGEGKLFDATVKTKGANDKLIPLKRNCPLENTADYGGYDNATTAYFSLVRSVGKKDKTQLSIEAIPVYVDLLGKDRVFDYLKNTVGLEQPQILIEKIKINSLLKLNGAYVWLRGKTNDSLTICNANQMVLDSEMTAYVKRIVSYNEKRKNNKDAKVDETYDNISKTGNLTLYNALLDKLTSHPYINFSALQKQAEFLKEKRDVFCELSVENQCTLLLEILHLMQCNSTSSNLTLIGGGSRAGVLTCNKKLSETGECLLITQSPTGYYKNIVNLTAYYRQ

SEQ ID NO: 8038 - protein, 1353 aa, unidentified
  REGION 1..1353: note = Description of Unknown:uncultivated organism sequence
MSKNYYIGLDMGTESVGWAVTDPDYNLVRQRGKDFWGAYLFDEAQTAEQRRTSRSGRRRIARTRHRLMLLQELFDREISAKDFGFFRRLEYSRYLSEDKAEEARGKYLLFNDENFTDKDFYKKYPTVFHLRSSLISEEISDVRLLYLAIHHIVKNRGHFLFEGQSFDGGDTQRATEEFRNINLFLGEYGKATFPEENWDEIFGFLCDNDMARSGRKEKILALTRSPKDKILANAVSAMVGLEFSLKKLFDAGEDDFAGADKLSFEDAGFDEKFANIRDALGDDRAAFVESLKKIHSLAKLNNILNGKKFISQAKTETYEAHRSDLAALKKYVRENCPEKYNLVFRRQKTKDKKADTEDGQEQSEKKKAVCNYAAYIGMDKGKGFAKCNKRDFYDFLKKEVKVKDEKILAKIEAGTFLPKSVSSENCEIPYQVHLEELKAILKNAENFFPFLKQKDESCGLNVSEKIVSLMKFRVPYYVGPFTDKETRFSWMIKKEGFEKEKITPWNFDSVVDKDKSEERFIQRMTNFCSYLTGEKVLPAASFLYSEFVFLNELNNLKVNGEKNPRAKEILYELAKREKKLTLKKCRDELVKQGLLPKDSKAQEVFSGTDGDFKSSLSSYIDFKRIIGDKADEYPDMCEQIILWITIISDKKRLEKLIREKYSEFLGEDEIKQIKSLNYTKWGRLSAKLLSGIYETDSDGEVGDKSIIERLREGTDNFMQLLSDGYGYKRSIDLANDDSSVDDRVTYRAVDELYCSPAVKRSIWSAVKIVREIIKVQGKAPAKVFVEMTREVKDGSKKGARTVSRKQELLKLYKENCKKEKELIKQLESADDIKFNSDKMFFYFTQMGRDIYTGEKIGFDDVFNTRLYDIDHIYPRSKIKDDSLNNRVLVSKKVNQSEKRDVYPLPGEMRSKMVDFWLELKEKKLISEEKYYRLMRSAPLTVSECEGFVNAQLVATSQSTKAAAQLLRRMLPGTEVVYSKAGNVNEFKDRLKFVKVRELNDLHHAKDAYFNIVVGNVFNTKFNHDAAVFFKDNGVGNYDFERIYDFDVKDAWKRGDENRIRSVAEKNTCRVVRFSKEEKGQLFNATIYPAGKNDKLIPVKGVGPLTDTSKYGGHNSAKTAYFMLVKSKGKKGETLLSLECVSVLADKKIRTIEDKLKYCETVLKLKEPEICIEKIKLNTLFRINGSYAWLRGKDNDRRNIFCNANQLWLDNDSTKYLKKISNHFKDVKKCNNKDLPVDEEKINARQNLALYDLLTEKLGSKTYAGLPCGGQANKLKSGRDKFEGLSLKDQCYVLMKVLEIMDCKNMGSDIRLVGGAANDGRNLINKFFQNSDVKIIFSSPTGYFRSVVDLKSFL

SEQ ID NO: 8039 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKHTLPLDKYAEIADVLKNRKTGKNAREAQLKKICDVDKADKTALAVIRCIVGKKADLKDLFGENHSVAKEKLCFDDVNFDKNYETLQLQLNDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVQDEQILQLIERGEFLPKLRTSVNGVIPYQVHRAELVAILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKAREEIFKYATEHKRVTLSGIGKLLEEKNLIECGEGKPENFSGTDGDFHSSLSSLIIMKRVLGENFDRDMAEQIILWATLTPDKDRLVRRVKSHYSLPDDVLKKIKGLSFSGWGRLSEKFLTDIWAADDDGVRTNIIEAMKSTGANLMELLSAKYGFSDAIKEFNADLNPSPNVEYSDVDELYCSPSVKRAIWRTVCLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQHIKQDVYPVSKEIRDKMHDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKNLFNYDLPGAWKVSEKERILQTARKNTCRVVRFVSEGRDGLFNATIKPKGANDKLIPLKANGPLADTDKYGGYDSASTAYFALVSSIGKKNEKTITLEAIPIYIDLLGENAVNDYIKRITGDKNATVLIEKIKLNSLLKICGSYCYLRGKTGSQIVLCNANQFIISDENAAYLKKISRFCEKNKKAEGKLTADEQHDGLTKDKNLEFYRMLADRLCSAPYSALLGQQAPGLREKESVFAALAIEEQCSVIMEVMHFFQCNSVTSNLQTIGGVPTAGKILKSKKLSENEEILLIYQSPTGFYQKTISLTGFYKA

SEQ ID NO: 8040 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRRILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDNDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVSDKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKRISNYMTDRKLLKRQDLPVGEKIKAEDNVRLYDALVEKLGSPVYRGLSIRKQAEFLKKSRERFISLSLEKQCVVIFEVLHLMQCNSVTADLTLLGGVPNAGSLVSSKFVQDNEMKIIYQSCTGYYREIIDFKRFL

SEQ ID NO: 8041 - protein, 686 aa, unidentified
  REGION 1..686: note = Description of Unknown:uncultivated organism sequence
MTDEEIKRIKGLNYTKWGRLSKKLLTGIYGYADSDGAVLSIIESMRLTNENFMSLMSAGYGFRSAIDEYNAAAARSGNVTYGTVQELYCSPSVKRAIWRSIELVREIIKIFGRAPKKLFIEMAREVNDDTRKGRRTVSRKQQLIDLYKNLREESRDWIAEIENMPDMKFNSDRLILYYRQLGRSMYSGNSIRLEDVFNKNVCDIDHIYPQSKIKDDSLDNKVLVFKTENAAKTDVYPINADIRNRMRGFWTELKNKGLISERKYERLTRSVPLTTDELSDFISRQLVETRQSTKAAAQLLKQMLPDTEIVYAKAGNANDFKDENEIIKVRELNNLHHAKDAYINIVVGNVYNTKFGHDASVYFRSHNTDSYNIKYLYTKDIPGAWRVADKDRIIKTVKKNTCRVVRFTSNGHGQLFNATIKTAGANDNLIPLKANGAISDTSKYGGYDSATTAYFMLVRSKGKKDKTLLSLEAVPIYADLQFAGDIDRKIAYCVEKLGLCSPEILIDNIKLNTLFCLDGSYAYIRGKTNKQIKLCNANELILDEQNTAYLKNISNYFRDKKKLNRSELPVGDKINGEDNLKLYDALIAKLSSKVYSGLNISGQAPMLSEKRDKFIELTLENQCKVLWEVLKLMQCNSTSSDFLLIGGSANTGIVVNNKNIQDQTVKMIYQSPTGYYRRVIDFSEFL

SEQ ID NO: 8042 - protein, 1349 aa, unidentified
  REGION 1..1349: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKHTLPLDKYAEIADVLKNRKIGKNAREAQLKKICDVDKADKTALAVIRCIVGKKVDLKDLFGENHSVAKEKLCFDDTDFDKNYETLQLQLNDEETAFVDAMKAVYDWAMLAEVLNGNTYLSLAMIERYRIHAEHLKMLKSYIKSECPERHAQTFRRNSNNNYAAYVGSDRGRDFKHCTCEDFYKYLRSFVKDEQILQLIERGEFLPKLRTSVNGVIPYQVHRAELVAILKNAEDNFPFLKEEQDGFTVAQKIIKLLEFRIPYYVGPLSSAHESKNPKKGFYWAVKNPGFETTKITPWNFDKIIDRDASEDKFISRMTNKCTYLLGEDVLPKSSLLYSEFTFRNELNNLCFKDNRLSEKAREEIFKYATEHKRVTLSGIGKLLEDKNLIERGEGKPENFSGTDGDFHSSLSSLITIKRVLGENFDRDMAEQIILWATLTPDKDRLVRRVKNHYSLPDDVLKKIKGLSFSGWGRLSEKFLTDIWAADDDGVRTNIIEAMKSTGANLMELLSAKYGFSDAIKEFNADLNPSPNVEYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKKYNQDIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDKPELSIVKIRELNDLHHAKDAYLNIVVGNVYFTKFNRNAAIFFKKNNIDSYNLKNLFNYDLPGAWKVSEKERILQTARKNTCRVVQFVSEERGQLFNDNISPQDTVTKGFVPIKANGPISDMYKYGGYTKVARAYFSLVSSSDKKGKKTITLEAIPIYIDLLGENAVNDYVKKVTGDKNATRLIDKIKMNSLLKIDSTYCYLSGKDDERRVSLCNANQFIISDEDAAYLKKISRFCEKNKKAEGRLTADEQHDGLTKEKNLEFYRMLVKRLEEKPYCLLPMPDSTTLLKSKENVFVMLNIEEQCSVIMEIMHFFQCNSVESDLTLLGGKKAGKVRRSKTIDPDEEILLISQSPTGFYQKTVSLTGFYKA

SEQ ID NO: 8043 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKHTLPLAKYAEIADVLKNRKTGKNAREAQLKKICDVDKADKTALAVIRCIVGKKVDLKDLFGENHSVAKEKLCFDDTDFDKNYETLQLQLSDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVQDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKEREEIFKYATEHKRVTLSGIGKLLEDKNLIECGEGKPENFSGTDGDFHSSLSSLIIMKRVLGENFDRDMAEQIILWATLTPDKDRLVRRVKSHYSLPDDVLKKIKGLSFSGWGRLSEKFLTDIWAADDDGVRTNIIEAMKSTGANLMELLSAKYGFSDAIKEFNADLNPSPNVKYSDVDELYCSPSVKRAIWRTICLVREIEKINGCPPKRIFVEMARGATEEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKKYNQDIKKDVYPVSKEIRDKMRDIWAVWLDKKLISKEKYKRLTRSTPLTEAELSDFINRQLVETRQSTKAVATLLKRMYPDSEIVYSKAGNVADFKEKVNNDYKKHDKPELSIVKIRELNDLHHAKDAYLNIVVGNVYFTKFNRNAAIFFKKNNIDSYNLKRLFDYDLPGAWKVSEKERILQTARKNTCRVVRFVSEGRDGLFNATIKPKGANDKLIPLKANGPLADTDKYGGYDSASTAYFALVSSIGKKNEKTITLEAIPIYIDLLGENAVNDYIKRITGDKNATVLIEKIKLNSLLKICGSYCYLRGKTGSQILLCNANQFIISDEDAAYLKKISRFCEKNKKAEGRLTADEQHDGLTKEKNLEFYRMLVSRLCSAPYSALLGQQAPGLREKESVFAALAIEEQCSVIMEVMHFFQCNSVLSDLSGISGVSKAGLVRNNKKLSKNEEILLIYQSPTGFYQKTVSLTGFYKA

SEQ ID NO: 8044 - protein, 928 aa, unidentified
  REGION 1..928: note = Description of Unknown:uncultivated organism sequence
MDKNYYIGLDMGTESVGWAVTDRDYNLVKQRGNDFWGVYLFDEAHTAEERRAFRAGRRRIARTRHRLMLLQELFDREISAKDFGFFRRLENSRYLSEDKAEEARGKYLLFNDEDFNDKDFYKKYPTVFHLRSSLISEEIKDVRLLYLAIHHIIKNRGHFLFEGQNFEVGDTQRATEEFRNINLFLGEYGKATFPEENWDEIFGFLCDNDMARSGRKEKILALTRSPKDKILANAVSAMVGLEFSLKKLFDAGEDDFAGADKLSFEDAGFDEKFANIRDALGDDRAAFVESLKKIHSLAKLNNILNGKKFISQAKTETYEAHRSDLAALKKYVRENCPEKYNLVFRRQKTKDKKADMEDGQEQSEKKKAVCNYAAYIGMDKGKGFAKCNKRDFYDFLKKEVKVKDEKILAKIEAGTFLPKSVSSENCEIPYQVHLEELKAILKNAENFFPFLKQKDESCGLNVSEKIVSLMKFRVPYYVGPFTDKETRFSWMIKKEGFEKEKITPWNFDSVVDKDKSEERFIQRMTNFCSYLTGEKVLPAASFLYSEFVFLNELNNLKVNGEKNPRAKEILYELAKREKKLTLKKCRDELVKQGLLPKDSKAQEVFSGTDGDFKSSLSSYIDFKRIIGDKADEYPDMCEQIILWITIISDKKRLEKLIREKYSEFLGEDEIKQIKSLNYTKWGRLSAKLLSGIYETDSDGEVGDKSIIERLREGTDNFMQLLSDGYGYKRSIDLANDDSSVDDRVTYRAVDELYCSPAVKRSIWSAVKIVREIIKVQGKAPAKVFVEMTREVKDGSKKGARTVSRKQELLKLYKENCKKEKELIKQLESADDIKFNSDKMFFYFTQMGRDIYTGEKIGFDDVFNTRLYDIDHIYPRSKIKDDSLNNRVLVSKKVNQSEKRDVYPLPGEMRSKMVDFWLELKEKKLISEE

SEQ ID NO: 8045 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAKRRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKRTLPLDKYVEIADVLKNRKTGKNAREAQLKKICDVDKADKTALAVIRCIVGKKVDLKDLFGENHSVAKEKLCFDDVNFDKNYETLQLQLSDEEAAFVDAMKAVYDWAMLAEVLNGNTYLSLAMIERYRIHAEHLKMLKSYIKSECPERYAQTFRRNSRNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSFAHESKNPKKGFYWAVKNPGFETTKITPWNFDKIIDRDASEDKFISRMTNKCTYLLGEDVLPKSSLLYSEFTFRNELNNLCFKDNRLSEKEREEIFKYASAHKRVTLSGIGKLLEENNLIERGEGKPENFSGTDGDFHSSLSSLITMKSVLGEYFDRDMAEQIILWATLTPDKDRLVRRVKNHYSLPDDVLKKIKGLSFSGWGRLSEKFLTDIWAADDDGVRTNIIEAMKSTGANLMELLSAKYGFSDAIKDFNADLNPSPNVQYSDVDELYCSPSVKRAIWRTICLVREIEKINGCPPKRIFVEMARGAAKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKKYNQDIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKRLFDYDLPGAWKVSEKERILQTARKNTCRVVRFVSEGRDGLFNATIKPKGANDKLIPLKANGPLADTDKYGGYDSASTAYFALVSSIGKKNEQTITLEAIPIYIDLLGENAVNDYIKRITGDKNATVLIEKIKLNSLLKICGSYCYLRGKTGSQILLCNANQFIIPDEDAAYLKKISRFCEKNKKAEGKLTADEQHDGLTKEKNLEFYRMLTDRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 8046 - protein, 971 aa, unidentified
  REGION 1..971: note = Description of Unknown:uncultivated organism sequence
MDKKYYIGFDIGTESVGWATTDDEYNLLKARGQDFWGVYLFDEAKTAAVRRGFRTMRRRYARRRQRIKLLQELFAEEISKVDFCFFERLNNSKYNVEDKNGSVKNKDCLFHDADFNDSEYFKKYRTIYRLRADFLDEEKAKEITDVRLLYLAVAHIIKNRGHFLFEGQEFNVGNKVVARQALSNINGILNVFDENAVTFAPEKFDEALDVLLETKTTKSDKARRLKQCLDVGDDKAGFAILKTIVGLKVNVKDMFDDKESSIKNFCFDDAGFELEKLRENFDDDEYSLICEAKKVYDWAVLAQILGQHKYISEAMLAKYVQHQKDLEVLKAYVKNGFGKEKYEEVFRNQEKIDNYAAYIGHDEKGNKSPHHATKEDFYKYLRSFVTDDEIKMRMDKGIFLEKQRSSANAVIPYQLQLAELKTILDNASENFPFLNSESDGISVKDKILKLLTFRIPYYVGPLNTAHADKGFAWVKKFDGTENERITPWNFDKIVDRQASETEFIKRMTNKCTYLVGEDVLPKQSLLYSEFAFLNELNNVTFKGRRLDKQAREAIVEYAKNNNRKITVKVLAAVLAKEGLIEQSDKAVENFAGIDGEIKSSFSTLRFFRRLFGDNFDVDMCEEIVKWSTIMGNQADVANRAGREFNLDAEIVKQLKGLNCSGWGRVSKMFLDSDEITTVDDSGEILTIIQAMRETGCNLMELLSQQYGFKNAVDRFNAQNVEEGKVSYKTVEDLYCSPSVKRAIWRTVCLAREIEKVQKCPPARIFIEMARGGDKNKKERTKSRKEQLVELYKSCKADVRSWISQGEIADLAKQIDGTDDARFLSDKLYLYYLQMGRCAYSGKPISIEQLFAKNVCNIDHIYPQSKIKDDSIINNRVLCFLEKNQTKQDVYPVAHEIREKMYPIWSDWHKRNLISDEKFKRLTRSTPLTQEELGDFINRQLVETRQSTKAVAQILKQMYPNTDSSTQKRATS

SEQ ID NO: 8047 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKRTLPLAKYAEIADVLKNRKTGKNAREAQLKKICDVDKADKTALAVIRCIVGKKVDLKDLFGENHSVAKEKLCFDDVNFDKNYETLQLQLSDEEAAFVDAMKAVYDWAMLAEVLNGNTYLSLAMIERYRIHAEHLKMLKSYIKSECPERYAQTFRRNSRNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKIMPWNFDKIIDRDASEDKFISRMTNKCTYLLGEDVLPKSSLLYSEFTFRNELNNLCFKDNRLSEKEREEIFKYATEHKRVTLSGIGKLLEEKNLIECGEGKPENFSGADGDFHSSLSSLITIKRVLGENFDRDMAEQIILWATLTPDKDRLVRRVKSHYSLPDDVLKKIKGLSFSSWGRLSEKFLTDIWAADDDGVRTNIIEAMKSTGANLMELLSAKYGFSDAIKEFNADLNPSPNVEYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQHIKKDVYPVSKEIRDKMRDIWAVWRDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKNLFDYDLPGAWKVSEKERILQTARKNTCRVVRFVSEGRDGLFNATIKPKGANDKLIPLKANGPLADTDKYGGYDSASTAYFALVSSIGKKNEKTITLEAIPIYIDLLGENAVNDYIRRITGDKNATVLIEKIKLNSLLKICGSYCYLRGKTGSQILLCNANQFIISDENAAYLKKISRFCEKNKKAEGKLTADEQHDGLTKEKNLEFYRMLVSRLCSAPYSALLGQQAPGLREKESVFAALAIEEQCSVIMEVMHFFQCNSVLSDLSGISGVSKAGLVRNNKKLSKNEEILLIYQSPTGFYQKTVSLTGFYKA

SEQ ID NO: 8048 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILNTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNRKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDNDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERRLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLAEPEIVIDRIKLNTLLYMDGSYAWLRGKTGNRIKLCNANQLYLNKEEMKILKRISNYMSDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 8049 - protein, 830 aa, unidentified
  REGION 1..830: note = Description of Unknown:uncultivated organism sequence
MTNFCSYLTGEKVLPAASFLYSEFVFLNELNNLKVNGEKNPRAKEILYELAKREKKLTLKKCRDELVKQGLLPKDSKAQEVFSGTDGDFKSSLSSYIDFKRIIGDKADEYPDMCEQIILWITIISDKKRLEKLIREKYSEFLGEDEIKQIKSLNYTKWGRLSAKLLSGIYETDSDGEVGDRSIIERLRDGTDNFMQLLSDGYGYKRSIDLANDDSSVDDRVTYRAVDELYCSPAVKRSIWSAVKIVREIIKVQGKAPEKVFVEMTREVKDGSKKGARTVSRKQELLKLYKENCKKEKELIKQLESADDIKFNSDKMFFYFTQMGRDIYTGEKIGFDDVFNTRLYDIDHIYPRSKIKDDSLNNRVLVSKKVNQSEKRDVYPLPGEMRSKMVDFWLELKEKKLISEEKYYRLMRSAPLTVSECEGFVNAQLVATSQSTKAAAQLLRRMLPGTEVVYSKAGNVNEFKDRLKFVKVRELNDLHHAKDAYFNIVVGNVFNTKFNHDAAVFFKDNGVGNYDFERIYDFDVKDAWKRGDENRIRSVAEKNTCRVVRFSKEEKGQLFNATIYPAGKNDKLIPVKGVGPLTDTSKYGGHNSAKTAYFMLVKSKGKKGETLLSLECVSVLADKKIRTIEDKLKYCETVLKLKEPEICIEKIKLNTLFRINGSYAWLRGKDNDRRNIFCNANQLWLDNDSTKYLKKISNHFKDVKKCNNKDLPVDEEKINARQNLALYDLLTEKLGSKTYAGLPCGGQANKLKSGRDKFEGLSLKDQCYVLMKVLEIMDCKNMGSDIRLVGGAANDGRNLINKFFQNSDVKIIFSSPTGYFRSVVDLKSFL

SEQ ID NO: 8050 - protein, 1350 aa, unidentified
  REGION 1..1350: note = Description of Unknown:uncultivated organism sequence
MDKKYYIGFDIGTESVGWATTDEEYNLLKARGQDFWGVYLFDEAKTAAARRGFRTMRRRYARRRQRIKLLQELFAEEISKVDFCFFERINNSKYNVEDKNGSVKHKDCLFHDADFNDSAYFKKYRTIYRLRADFLDEEKAKEITDVRLLYLAVAHIIKNRGHFLFEGQEFNVGNKVVARQALSNINGILNVFDENAVTFAPEKFDEALDVLLETKTTKSDKARRLKQCLDIGDDKTGFAILKTIVGLKVNVKDLFDDKESSIKNFCFDDAGFELEKLRENFDDDEYSLICEAKKVYDWAVLAQILGQYKYISEAMLAKYVQHQKDLELLKAYVKNDFGKEKYEEVFRNQEKIDNYAAYIGHDEKGNKSPHHAAKEDFYKYLRSFVTDDEIKMRMDKGIFLEKQRSSANAVIPYQLQLAELKTILDNASENFPFLNSESDGISVKDKILKLLTFRIPYYVGPLNTAHADKGFAWVKKFDGTENERITPWNFDKIVDRQASETKFIKRMTNKCTYLVGEDVLPKQSLLYSEFAFLNELNNVTFKGRRLDKQAREAIVEYAKNNNRKITVKVLAAVLAKEGLIEQSDKAVENFAGIDGEIKSSFSTLRFFRRLFGDNFDVDMCEEIVKWSTIMGNQADVANRAGREFNLDAEIVKQLKGLNCSGWGRVSKTFLDSDEITTVDDSGEILTIIQAMRETGCNLMELLSQQYGFKNAVDRFNAQNVEDSKVSYKNVEDLYCSPSVKRAIWRTVCLAREIEKVQKCPPARIFIEMARGGDKNKKERTKSRKEQLVELYKSCKADVRSWISQEEIADLAKQIDGTDDARFLSDKLYLYYLQMGRCAYSGKPISIDQLFAKNVCNIDHIYPQSKIKDDSIINNRVLCFLENNQTKQDVYPVAHEIREKMYPIWSDWHKRNLISDEKFKRLTRSTPLTQEELGDFINRQLVETRQSTKAVAQILKQMYPNTDIVYSKASNVVDFKNKINDTKQQPQIVKVRELNDLHHAKDAYLNIVVGNVYYTKFNRNAVEYLKNNGIDSYNMKYLFDNTLKNAWLPSYKQKVVSIVNKNTCRVVRFVSEGEGKLFDATVMPMGKNDKLIPLKRNCPLEKTDKYGGYDAATTGYFALVKSYGKKDKIQLSLEAIPVYIDLLGKDKVQDYLVNNVGLKNPQILIEKIKINSLLKLNGAYFWLRGKTGDRILICNANQLVLDHDSVCYLKKVVSFVDKEKKDGKQLIPTAEFDGISKDDNLRLYDALIDKMSNTPYSNISSFALQTQFLNSKRNSFCELCEKDQIKVLLEVLHFLQCNPVLSNLKLIDGSPNSGLLRHSKNISQDEECLLITQSPTGYYKDTVNLTAYFDK

SEQ ID NO: 8051 - protein, 1379 aa, unidentified
  REGION 1..1379: note = Description of Unknown:uncultivated organism sequence
MQQIQCTHRVLPKNRRFEKILFELMVLFRTVVNRSSTFIINNTREDVNRKMKNYYVGIDMGTNSVGWAATDCEYHLLKARGQDLWGSYLFDEAEGAQKRRSFRTARRRTARTRQRLLLLQSLFQEEMAKKDPLFFIRLNNSPLVLKDKNESLKTSDSLFADQSFTDKNYFKKYPTIYHLRASLINDKIKDVRLLYLAVHHIIKNRGHFLFESQNFNVANEEVVKDKFFAINAFLSDREMPTLNLERLHEVLQVLKQTKSSKRDKQKTLGELLGVSKEKPLTSIVKALIGGTVSLKDLYSAESDFDDIKSFCFDKASFEDSDLPAIKSAVGEDDAELVLLLKSVYDWTVLCGIMGDEEYISFAKVKIYNKHKSDLVWLKNYVRQNFSKETYNEVFRRKDKKNNYAAYIGMDKQKGFSKCKQEDFYAFLKKRLNITDETVLAEMDKGQFLPKQVIKTNGVVPYQLHLLELKAILRNAQKYFSFLSEKQEGVTVAEKIVSLMTFRIPYYVGPLNTASKKYAWAVRRPGYENVSITPWNFHQIVDGDASEEQFIRRMTNKCTYLVGQDVLPANSLLYSEYVFLNELNNLRINGEKNNKARQLIFHYAKQHKRVTLKNCLALLVRNGLLPADSSTDVFSGLDGDFKTSLSTWYDFRFLGDRLQTQREMCEQIILWITLISDKNRLEKRIRTAYGQYLSDEEIKRIKGFNYSKWGRLSKILLDGIVSERCFDENGELLTIIEAMRQKGENFMQLLSDKYGFQDAIERYNQENSPSDDKVSYQTVEDLYCSPSVKRAIWRTVEIVREIVKIQGCAPQKLFLETARETKDNGKAGKRTVSRKQQLLDLYKDIHLQQHDWIKEIESLPDSKFNSDRLVLYYRQLGRSMYSGKPIKLEEVFDRNICDIDHIYPQSKIKDDSLDNRVLVYKNENSVKSDKYPISSEVRNAMRPFWQSLWVQGLISERKYQRLIRSTPLTVDELADFINRQLVITRQSTKATAQILKQMLPDTEIVYTKAANANEFKDKNNLLKVRELNDLHHAKDAYINIVVGNVYNTKFNHNAAVFFRNNSIDSYNFNKLYESDIPGAWRVAQKADVLATFQKNTCKVVRMTVNGHGALFDVNPVVAGKNADLVPLKKHGAIADTSRYGGYNSAKTAYFVLVRSDGKAGKQLLSLEQWPLWMEKQTGGSTEAKLNYFSQKLTNPKICIDGIKQNTLLCVNGSYAWLKGKTGNSISLCNANQLFLDGENVQTLKLIGNYMRDRKTFNNPQMPANEKITAENNLRLYDALVQKLSSSLYAGLAICGQVPFLKEKRPVFVSLSVEKQCCVLWEVLRLMQCNVGLSDFTLLGGVANAGVTTINKFIQDKNIKLIFQSPTGYYRTVVDVGRFLK

SEQ ID NO: 8052 - protein, 1357 aa, unidentified
  REGION 1..1357: note = Description of Unknown:uncultivated organism sequence
MIRRCQEVNKKYYIGFDIGTESVGWATTDEEYNLLKARGQDFWGVYLFDEAKTAAARRGFRTARRRYARRRQRIKLLQELFAQEISKVDFSFFERLNNSKYNVEDKNGNVQYKDCLFHDSDFNDSAYFKKYNTIYSLRAAFLDKEKAKEIKDIRLLYLTVAHIVKNRGHFLFEGQEFNVGNKDVARQALSNINGILIALDENAVTFAPEKFDEALGVLLEQKTTKSEKERRLKQCLGVDGNKACLAIIKAMVGLQVNVKNLFEDKEPSIKNFCFDDAGFEVEKLRENFDEDEYSLICEAKKVYDWAVLAQILGQHKYISEAMLAKYDRHKKDLELLKAHVKNDFGKEKYEEVFRNKEKIDNYAAYIGHDEKGNKSPNHATKEEFYKYLRSFVTDDEIKGRMDKGIFLEKQRSSANAVIPYQLQLAELKAILDNASDNFPFLNSESDGMSVKDKILKLLTFRIPYYVGPLNTAHSDKGFAWVKKFDGTENDRITPWNFDKIVDRQASETEFIKRMTNKCTYLVGEDVLPKQSLLYSEFAFLNELNNVTFKGHRLDKQAREAIVRYAKNNNRKITLKVLADVLAKEGLIEQSDKATENFAGIDGEIKSGFSTLRFFKRVFGDDFDVKMCEEIVKWFTIMSNKDDVAKRVEREFGIDKETTKKLKDLNCSGWGKLSATFLDSDEITTVDGSGEILTIIQAMRETGCNLMELLSQQYGFKSAVDRFNSQNVEDGKVSYKTVEDLYCSPSVKRAIWRTVCLAREIEKVQGCPPARIFIEMARGGDKNKKERTKSRKEQLVELYKSCKADVRSWISQEEIADLAKQIDSTDDAGFLRDKLYLYYLQMGRCAYTGKPISIEQLFAKNVCNIDHIYPQSKIKDDSIINNRVLCFLDNNQSKKDVYPVAHEIREQMYPIWSDWHKRKLISDEKFKRLTRNTPLTQEELGDFINRQLVETRQSTKAVAQILKQMYPNTDIVYSKASNVVDFKNKINDNKQQPQIVKVRELNDLHHAKDAYLNIVVGNVYYTKFNRNAVEYLKNNGIDSYNMKYLFDNNLKNAWMPSYKQKVVSIVNKNTCRVVRFVSEGEGKLFDATVKTMGRNDKLIPLKLNCPLEQTDKYGGYDSATTGYFALVRSYGKKDTIQLSLEAIPVYIDLLGKDKVQDYLVNNVGLKNPQILIEKIKINSLLKLNGAYFWLRGKTCDRIVICNANQLVLDHDSACYLKKIVSFVDKEKKEGKQLIPTVEFDGIAKDDNLKLYDALIDKMGSAPYSNISSFALQTKFLSSKRNSFGELCEKDQIKVLLEVLHFLQCNPVLSNLKLIDGSANSGSLLHSKKISQDEECLLITQSPTGYYRDTVNLTAYFDK

SEQ ID NO: 8053 - protein, 1344 aa, unidentified
  REGION 1..1344: note = Description of Unknown:uncultivated organism sequence
MRENYYVGLDIGTDSVGWAVTDPEYKLLRVKGKDMWGAYLFDPAKTAADRRGYRTARRRTARVRQRIKLLQELFAAEVYAVDPAFFIRMDQSKFVESDKTIDGKDAIFHDESFGDKEFYKKFPTIYHLRAAFLDPQQARDITDVRLLYLAVHHIIKNRGHFLFEGQNITAGDTGLLQENFSAINAYLSDNDQHQLPLDGYAAIADILKDRKAGKNAREAQLKAVCDVDKADKTALAAIRCFVGKKVDLKDLFGENHVAAKEKLCFDDVNFDKNYDTLRAQLTDEEAAFVDAMKAVYDWAMLAEVLDGNTYLSLAMIERYRRHAEHLKMLKDYIKAECPEKYAQTFRRNASNNYAAYVGSDRGKGFKHCTREDFYKYLRSFVKDEQILSLIERGEFLPKLRTSVNGVIPYQVHRAELVAILKNAEANFPFLKEEQDGFTVAEKIIKLFEFRIPYYVGPLSSAHESKNPKKGFYWAVKNPGFETTKITPWNFDRIIDRDASEDKFIGRMTSKCTYLLGEDVLPKSSLLYSEFTFRNELNNLCFKGNRLPEDAREEIFKYATGHKRVTLSGIGKLLEDENLIERGEGKPENFSGTDGDFHSSLSSLITMKNVLGEYFDRDMAEHIILWATVTPDKDRLVRRVKNNYSLPEDVLKRIKGLTFSGWGRLSEKFLTDIWAADGDGVRTNIIGAMKSTGANLMELLSAKYGFSDAVNAFNADNTPSSDVGYPDVDELYCSPSVKRAIWRTICLVREIEKINGCPPKRIFVEMARGATEEQKGKRTTSRKEQIKALFKDIRDNERDWMAEIETQPDSVFSSDKMFMYYMQMGKCAYSGKNIPLNEVFNTNIYDIDHIYPQSKIKDDSLDNRVLCSKEYNQHIKKDVYPVPKEIRDNMRDIWAVWLDKKLISKEKYKRLTRSTPLTEAELSDFIDRQLVETRQSTKAVATLLKRMYPDSEIVYSKAGNVAAFKEKVNNDYKKHDKPELSIVKIRELNDLHHAKDAYLNIVVGNVYFTKFNRNAAIFFKKNGIDSYNLNRLFDCDLPGAWKVSEKERILQTARKNTCRVVRFVSEGRGQLFNDNISPQDTVTKGFVPIKANGPISDMYKYGGYTKVARAYFSLVLSSGKKGKQTITLEAIPIYIDLLGENAVNDYVKKVTGDKNAIRLIDKIKMNSLLKIDGTYCYLIGKADERRVLLCNANQFIISDENAAYLKKISRFCEKNKKAEGKLIADEQHDGLTKDKNLEFYRMLVKRLEEKPYCLLPMPDSTTLLKSKENVFVMLNIEEQCSVIMEIMHFFQCNSVESDLTLLGGKKTGMVRRSKTIDSDEEILLISQSPTGFYQKAISLTGFYKA

SEQ ID NO: 8054 - protein, 1353 aa, unidentified
  REGION 1..1353: note = Description of Unknown:uncultivated organism sequence
MSKNYYIGLDMGTESVGWAVTDRDYNLVKQRGNDFWGVYLFDEAHTAEERRAFRAGRRRIARTRHRLMLLQELFDREISAKDFGFFRRLENSRYLSEDKAEEARGKYLLFNDEDFNDKDFYKKYPTVFHLRSSLISEEIKDVRLLYLAIHHIIKNRGHFLFEGQNFQVGDTQRATEEFRNINLFLGEYGKATFPEENWDEIFGFLCDNDMARSGRKEKILALTRSPKDKILANAVSAMVGLEFSLKKLFDAGEDDFAGADKLSFEDAGFDEKFANIRDALGDDRAAFVESLKKIHSLAKLNNILNGKKFISQAKTETYEAHRSDLAALKKYVRENCPEKYNLVFRRQKTKDKKADTEDGQEQSEKKKAVCNYAAYIGMDKGKGFAKCNKRDFYDFLKKEVKVKDEKILAKIEAGTFLPKPVSSENCEIPYQVHLEELKAILKNAENFFPFLKQKDESCGLNVSEKIVSLMKFRVPYYVGPFTDKETRFSWMIKKEGFEKEKITPWNFDSVVDKDKSEERFIQRMTNFCSYLTGEKVLPAASFLYSEFVFLNELNNLKVNGEKNPRAKEILYELAKREKKLTLKKCRDELVKQGLLPKDSKAQELFSGTDGDFKSSLSSYIDFKRIIGDKADEYPDMYEQIILWITIISDKKRLEKLIREKYSEFLGEDEIKQIKSLNYTKWGRLSAKLLSGIYETDSDGEVGDKSIIERLREGTDNFMQLLSDGYGYKRSIDLANEDSSADERVTYRTVDELYCSPAVKRSIWSAVKIVREIIKVQGKAPAKVFVEMTREVKDGSKKGARTVSRKQELLKLYKENCKKEKELIKQLESADDIKFNSDKMFFYFTQMGRDIYTGEKIGFDDVFNTRLYDIDHIYPRSKIKDDSLNNRVLVSKKVNQSEKRDVYPLPGEMRSKMVDFWLELKEKKLISEEKYYRLMRSAPLTVSECEGFVNAQLVATSQSTKAAAQLLRRMLPGTEVVYSKAGNVNEFKDRLKFVKVRELNDLHHAKDAYFNIVVGNVFNTKFNHDAAVFFKDNGVGNYDFERIYDFDVKDAWKRGDENRIRSVAEKNTCRVVRFSKEEKGQLFNATIYPAGKNDKLIPVKGVGPLTDTSKYGGHNSAKTAYFMLVKSKGKKGETLLSLECVSVIADKKIRTIEDKLKYCETVLKLKEPEICIEKIKLNTLFRINGSYAWLRGKDNDRRNIFCNANQLWLDNDSTKYLKKISNHFKDVKKCNNKDLPVDEEKINARQNLALYDLLTEKLGSKTYAGLPCGGQANKLKSGRDKFEGLSLKDQCYVLMKVLEIMDCKNMGSDIRLVGGAANDGRNLINKFFQNSDVKIIFSSPTGYFRSVVDLKSFL

SEQ ID NO: 8055 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDDDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKRISNYMTDRKLLKRQDLPVGEKIKAEDNVRLYDALVEKLGSPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 8056 - protein, 1328 aa, unidentified
  REGION 1..1328: note = Description of Unknown:uncultivated organism sequence
MGKNYYIGIDMGTDSVGWAVTDEEYRLLKSKGRDLWGSYLFEEAQAAAQRRSFRTARRRTARTRQRLLLLQSLFAEEMAKVDPLFFLRLNNSSLFLQDKDGKLRCSDALFGDPSYRDKDYFAEYPTIYHLRAALLQGEVKDIRLLYLAIHHIIKNRGHFLFESQSFSVGDTQTVREKFTAINAFLSDREMPTLELSALSEGLEVLRNSRIGKRDKQLRLKDIFKTGGEKSLIALVKALTGGSVNLKELYCAEESFADVSVFSFEKASFDETDLPAIENAVGQEEAELVLLLKSVYDWSVLCAIMGEEQFISLAKKKIYEKHKADLCRLKEYIRKNCPEKYADVFRRREKKSNYAAYIGMDKQKGCAKCKRGDFYAFLKKEIKIEDEYILTEIEKGEFLPKQVSDANGVIPYQVHLLELKAILANAAGKFPFLTDERDGSTVAEKIISLMTFRIPYYVGPLHTQSPFAWAVRKSGYERTSVTPWNFDSVIDADASEEQFIRRMTNKCTYLAGQDVLPANSLLYSEFTFLNELNNLRVNGVKNDAARKLIYEYAKQHKKVTLKNCLALLIREGLLPVGSRAEETFSGIDGDFKTSLAPWYDLRFLGNKIETHREMCEEIIIWITLISDKERLEKRIRRAYGTILSDEEIKRFKGLNYSKWGRLSAVLLDGIVSPRCADENGEPLTIIRAMRATGENFMQLLSAKYGYQEAIDAYNAENAPRGKVTYKTVEDLYCSPSVKRAIWRTVELVREIAKICGGAPKKLFIETVREVNDDRRGQRTVSRKQQLIDLYKNIKKEERDWIAEIENTADKKFDSDRLVLYYRQLGRSMYSQKPIRLEDVFDTNICDIDHIYPQSKIKDDSLDNRVLVFKTENTAKGDRYPLSADVREKMISFWRELKDRALIGEKKFERLTRTTALTQEELADFINRQLVSTSQSTKAAAQILGEIFPDTEIVYAKAGNANRFKDENKIVKVRELNDLHHAKDAYVNIVVGNVYNTKFNHNAAVYFRDHGVDSYNLKNLFTHDIPGAWKVSEKERILQTVAKNTCRVVRMTENGKGKLFDIQPKSAGKNADLIPLKICGAISDTAKYGGYDSATTAYFMLVRSKGKKGKVALSLEAYPLWLDKRGGGAKEDKLRFCVERAGLKEPEIIVDNIKLNTLFCIDGSYAWLRGKTGNRVVWCNANELFLDEESMRTLKNISNYMRDRKRLNKPDLCAGDKITAECNIRLYDALVEKLGSSVYAGLSVKGQVPFLRGKREAFAELSREDQCKIIFEVLHLMQCNSVLSDFSSLGGVAHAGSILSNKFVQDMGIKMIFQSPTGYYRRVVDLKEFI

SEQ ID NO: 8057 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFFDDDLSEGNKRTLPLDKYAEIADVLKNRKTGKNAREAQLKKICDVDKADKTALAVIRCIVGKKVDLKDLFGENHSVAKEKLCFDDTDFDKNYETLQLQLSDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVQDEQILQLIERGEFLPKLRTSVNGVIPYQVHRAELVAILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKAREEIFKYATEHKRVTLSGIGKLLEEKNLIECGEGKPENFSGTDGDFHSSLSSLITIKRVLGENFDRDMAEQIILWATLTPDKDRLVRRVKSHYSLPDDVLKKIKGLSFSGWGRLSEKFLTDIWAADDDGVRTNIIEAMKSTGANLMELLSAKYGFSDAIKEFNADLNPSPNVQYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQHIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKRLFDYDLPGAWKVSEKERILQTARKNTCRVVRFVSEEHGKLFDATIKPKGANDKLIPLKANGSLADTDKYGGYDSASTAYFALVSSIGKKNEKTITLEAIPIYIDLLGENAVNDYIKRITGDKNATVLIEKIKLNSLLKICGSYCYLRGKTGSQIVLCNANQFIISDENAAYLKKISRFCEKNKKAEGRLTADEQHDGLTKEKNLEFYRMLVSRLCSAPYSALLGQQAPGLREKESVFAALAIEEQCSVIMEVMHFFQCNSVTSNLQTIGGVPTAGKILKSKKLSENEEILLIYQSPTGFYQKTISLTGFYKA

SEQ ID NO: 8058 - protein, 1328 aa, unidentified
  REGION 1..1328: note = Description of Unknown:uncultivated organism sequence
MDKKYYIGIDMGTDSVGWAVTDEEYNLLKARGNELWGSYLFDEGEGAQDRRAFRTSRRRTARTRQRLLLLQSLFAEEISKVDPLFFIRLNNSSLFFKDKDGRLTTSDALFADIGFTDKQYYALYPTIYHLRATLINGEVKDIRLLYLALHHILKNRGHFLFEAQSFETENSELVRQKFYEVNLALSDLELPTLDLEQLDEVMTCLKQNKGGKRDRQKKLSELLKTGKDKCLLSVVKAITGGNTSLKELYGADDDYEDIKSFSFEKASFEDKDLPAIESAVGIDNIALVMSLKAIYDWSVLCGIMGDEKYISLAKVKIYEKHKADLKWLKDYISNHCPEKYADVFRHKIKVNNYAAYIGMDRHKGYSKCSKDDFYAYLKKVVGISDEQVLSEMDKGEFLPKQVSNANGVIPYQVHLQELKAILHNAEKYFPFLAKEQDGLTVSEKIISLITFRIPYYVGPLNTGSKFAWSIRHKGYENVSITPWNFDKAIDADASEEEFIRRMTNKCTYLIGQDVLPASSLLYSEFTFLNELNNLRINGQKNEEARRLIYEYAKEHKKVTIKNCLSLLIRNGVLPAGSTAEVFSGIDGDFKSSLSPWYDLRFMGELVNTRRDMCEEIICWITLISDKDRLEKRIRKKYGDVLSAERIKRIKGLNYSKWGRLSATLLDGIVSPQCADENGELMTVIQAMRNTGENFMQLMSAKYGFAAAVNEFNAENMPSGKITYSAIKDLRCSASVKRAIWRTVVLVKEIVKVCKGAPEKLFIETAREVNDDSRKGKRTVSRKQQLIDLFKNIKGEESNWVSEIEGTVDTKFNSDKLVLYYRQLGRSMYSGKPISLEQVFDTNICDIDHIYPQSKIKDDSLDNRVLVFKTENSLKSDNYPLTDDIRRDMTPFWRALREKGLMSDKKYERLVRTTPLTQDELADFINRQLVSTRQSTKEAARILGEMLPETEIVYSKAGNANEFKDKFGIIKVRELNDLHHAKDAYINIVVGNVYNTKFNHNAAVYFRSNDLNSYNLKYLYDRDIKGAWKVGDLKRILHTVSKNTCKVVRMTLGGKGRLFDVNPVPAGTNDDLVPLKAKGAITDTSKYGGYNKATTAYFMLVKSTGKNGKTILSLEAYPLYLDKQTGGSKEAKIEFCKNRQGLKDAQILIDNIKLNTLFCIDGSYAWLRGRTGDRVIWCNANQLFLDEPLVKYLKSISNYMRDRKKLNNPDLQAGKSITSEDNLFIYDALTQKLASPIYAGLSIKGQVSFLSQKRDAFVVLSLEEQCRVLFEILHLMQCKSVPADLTLLGGAARAGVILSNKFVQDVNIKMIYQSPTGYYRKVVNLKELL

SEQ ID NO: 8059 - protein, 1327 aa, unidentified
  REGION 1..1327: note = Description of Unknown:uncultivated organism sequence
MDKDYYIGLDMGTDSVGWAVTDTDYNLLKSRGRDMWGSYLFDPAETAAARRGFRTARRRTARTRQRLNLLQDLFAAEIEKIDPTFFIRLNNSSLFMEDKDERLDTANILFADNGYTDKDYFKAFPTIYHLRAYLLDGKVSDIRFLYLAVHHIIKNRGHFLFEGQNFDVGDTETVKTAFEKVNQIFSENDVPGELVLCDIDKALDVLKDKRIGKKDKVRQLKELLHVGKDKTLSAAINAITGCTASLKNLYDTEEDLGDANKFCFADGAFDENKLPAIEAAVGFDEAELVRQLKSIYDWSVLCEILGDEKYISKAKIQIYKRHAEDLLELKTYIRENCPEKYALTFRHNKENNYAAYIGMDKRKGHKKCNREEFYAFLKKTVGVSGDILEKIEAGEFMPKQVSNANGVIPYQVHLLELHQILLNAARYFPFLSERSDGFSVSEKIEMLMTFRIPYYVGPLNTDSGFAWVKKYAGQERVSVTPWNFDKVVDRDASEQGFIRRMTNKCTYLKGEDVLPESSFLYSEFVFLNELNNLKINGIKDPQAKALIYEYAKTHKKITLKKCHELLVNNGILRPDSKKDEIFSGLDGDFKKSLGSYVDFRNIIGDKADTHSEMCEEIILWITLTSDKNRLVKKIKQKYGNILTDEEIKRIKGLNYTKWGRLSKKLLTGIYGYADSDGAVLSIIESMRLTNENFMSLMSAGYGFRSAIDEYNAAAARSGNVTYGTVQELYCSPSVKRAIWRSIELVREIIKIFGRAPKKLFIEMAREVNDDTRKGRRTVSRKQQLIDLYKNLREESRDWIAEIENMPDMKFNSDRLILYYRQLGRSMYSGNSIRLEDVFNKNVCDIDHIYPQSKIKDDSLDNKVLVFKTENAAKTDVYPISADIRNRMRGFWTELKNKGLISERKYERLTRSVPLTTDELSDFISRQLVETRQSTKAAAQLLKQMLPDTEIVYAKAGNANDFKDENEIIKVRELNNLHHAKDAYINIVVGNVYNTKFGHDASVYFRSHNTDSYNIKYLYTKDIPGAWRVADKDRIIKTVKKNTCRVVRFTSNGHGQLFNATIKTAGANDNLIPLKANGAISDTSKYGGYDSATTAYFMLVRSKGKKDKTLLSLEAVPVYADLQFAGDIDRKVAYCVEKLGLCSPEILIDNIKLNALFYLDGSYAYIRGKTGNRVVFCNANELILDEQNAAYLKNISNYFRDKKKLNRSELPVGDKINAEDNLKLYDALIAKLSSKIFAGLKISGQAPMLSEKRDKFIELTLENQCKILWEVLKLMQCNSSLSDFSSMGGAANAGSIFVAKNIQDQSVKMIYQSPTGYYRRVVDFSEFL

SEQ ID NO: 8060 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEGNKRTLPLDKYAEIADVLKNRKTGKNAREAQLKKICDVDKADKTALAVIRCIVGKKVDLKDLFGENHSVAKEKLCFDDVNFDKNYETLQLQLSDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEQEREEIFKYASTHKRVTLSGIGKLLEEKNLIECGEGKPENFSGTDGDFHSSLSSLITMKSVLGENFDRDMAEQIILWATLTPDKDRLVRRVKNHYSLPDDVLKKIKGLSFSGWGRLSEKFLTDIWAADDDGVRTNIIEAMKSTGANLMELLSAKYGFSDAIKDFNADLNPSPNVQYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQHIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKRLFDYDLPGAWKVSEKERILQTARKNTCRVVRFVSEEHGKLFDATIKPKGANDKLIPLKANGPLADTDKYGGYDSASTAYFALVSSIGKKNEQTITLEAIPIYIDLLGENAVNDYIKRITGDKNATVLIEKIKLNSLLKICGSYCYLRGKTGSQILLCNANQFIISDEDAAYLKKISRFCEKNKKAEGRLTADEQHDGLTKEKNLEFYRMLVKRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 8061 - protein, 1350 aa, unidentified
  REGION 1..1350: note = Description of Unknown:uncultivated organism sequence
MNKKYYIGFDIGTESVGWATTDEEYNLLKARGQDFWGVYLFDEAKTAAARRGFRTARRRYARRRQRIKLLQELFAQEISKVDFSFFERLNNSKYNVEDKNGNVQYKDCLFHDSDFNDSAYFKKYNTIYSLRAAFLDKEKAKEIKDIRLLYLTVAHIVKNRGHFLFEGQEFNVGNKDVARQALSNINGILIALDENAVTFAPEKFDEALGVLLEQKTTKSEKERRLKQCLGVDGNKACLAIIKAMVGLQVNVKNLFEDKEPSIKNFCFDDAGFEVEKLRENFDEDEYSLICEAKKVYDWAVLAQILGQHKYISEAMLAKYDRHKKDLELLKAHVKNDFGKEKYEEVFRNKEKIDNYAAYIGHDEKGNKSPNHATKEEFYKYLRSFVTDDEIKGRMDKGIFLEKQRSSANAVIPYQLQLAELKAILDNASDNFPFLNSESDGMSVKDKILKLLTFRIPYYVGPLNTAHSDKGFAWVKKFDGTENDRITPWNFDKIVDRQASETEFIKRMTNKCTYLVGEDVLPKQSLLYSEFAFLNELNNVTFKGHRLDKQAREAIVRYAKNNNRKITLKVLADVLAKEGLIEQSDKATENFAGIDGEIKSGFSTLRFFKRVFGDDFDVKMCEEIVKWFTIMSNKDDVAKRVEREFGIDKETTKKLKDLNCSGWGKLSATFLDSDEITTVDGSGEILTIIQAMRETGCNLMELLSQQYGFKSAVDRFNSQNVEDGKVSYKTVEDLYCSPSVKRAIWRTVCLAREIEKVQGCPPARIFIEMARGGDKNKKERTKSRKEQLVELYKSCKADVRSWISQEEIADLAKQIDSTDDAGFLRDKLYLYYLQMGRCAYTGKPISIEQLFAKNVCNIDHIYPQSKIKDDSIINNRVLCFLDNNQSKKDVYPVAHEIREQMYPIWSDWHKRKLISDEKFKRLTRNTPLTQEELGDFINRQLVETRQSTKAVAQILKQMYPNTDIVYSKASNVVDFKNKINDNKQQPQIVKVRELNDLHHAKDAYLNIVVGNVYYTKFNRNAVEYLKNNGIDSYNMKYLFDNNLKNAWMPSYKQKVVSIVNKNTCRVVRFVSEGEGKLFDATVKTMGRNDKLIPLKLNCPLEQTDKYGGYDSATTGYFALVRSYGKKDTIQLSLEAIPVYIDLLGKDKVQDYLVNNVGLKNPQILIEKIKINSLLKLNGAYFWLRGKTCDRIVICNANQLVLDHDSACYLKKIVSFVDKEKKEGKQLIPTVEFDGIAKDDNLKLYDALIDKMGSAPYSNISSFALQTKFLSSKRNSFGELCEKDQIKVLLEVLHFLQCNPVLSNLKLIDGSANSGSLLHSKKISQDEECLLITQSPTGYYRDTVNLTAYFDK

SEQ ID NO: 8062 - protein, 1356 aa, unidentified
  REGION 1..1356: note = Description of Unknown:uncultivated organism sequence
MDKKYYIGFDIGTESVGWATTDEEYNLLKARGHDFWGTYLFDPAKTAAERRGYRMSRRRFARRRQRIKLLQEIFAQEISKVDFCFFERLNNSKYNVEDKAENVKYSDSLFHDEIFNDKEYFKKYKTIYHLRKAFLDAESAAEIKDVRLLYLAVAHIIKNRGHFLFEGQEFNAGDKDLAIRAFENVNAALCDMDEDKQSLSLDKLDDVFDTLRDKKSTKRDKVKKLKELLGVQKDKTCQEIVNAIVGCKAKSANLFGEGEYEIKDFCFDDGGFELEKVQNAFSEEEFGLICNLKAIYDWAVLAQILGDHQYISQAMCAKFDSHCEDLKMLKDYVKSEFGQAKYNEVFRKQKDLKNYAAYIGKDRNQSFNHASKEDFYKYLKSFVKDETILAKIEEGIFLEKQRTNANGVIPYQVHKAELELILDNASANFPFLNEESDKMTVKDKIVKLLTFRIPYYVGPLNTAHAEKGFAWVKKFDGTENERITPWNFDKIVDRQASEDEFIKRMTNKCTYLVGEDVLPKQSLLYSEFAFLNSLKNVSFKGRRLDKQARDAIVDFAKRNGKRNITLKVVGNVLAKAGLIEQSENKVENFAGIDKEIKNGFSTLCTFRRIFGDKFDADKCEEIIKWSTIMGNQEDATKRAAREFGLDKEIVKQLKGLNFSGWGNLSKRFLDSDDISVVTQDGEILTLIEAMRETDYNLMELLSKQFGFSAAIDRFNAQNADDGAVTYKTVEDLYCSPSVKRAIWRTVCLAREIEKAQGCPPDRIFVEMTRGGDERKKGARTKTRKEQLTELYKVCKTDVRDWVSQDEVFDLTKQIENTDDAKFLSDKLYLYYLQMGRCAYTGKPIHIEDLLTKNTCDIDHIYPQSKRKDDSVLNNKVLCYKTTNSNKKDVYPIDADIRKNMLPLWTLWHDKKLINDEKFKRLTRCTPLTQEELADFINRQLVETSQSTKAVAQLLKQMYPDSVIVYSKAKNVTEFKNYINSKGNKNGEKNPPKIVKVRELNDLHHAKDAYLNIVVGNVYYSKFNRDALTYLKENGFDSYNLNKLFDENLKKGWNPFMADKVVATVNKNTCRVVRFTSEGKGKLFDATIKVKGANDKLIPLKRNCPLEKIDKYGGYDSATTAYFALVKSADKKGKPQLSLEAIPIYVDLLGKDKVLDYLKNNVALVDPQVLIEKIKINSLLKINGAYVWLRGKTGDRIVLCNANELILDHESVCYLKKIVSFRNKGKKWNVQIIPTVEFDGIAKEDNIRLYDVFVEKLLSTPYSNISSFRQQADLLQTNRNIFVELCEMDQIEVLAEVLHFMQCNSVLSKLTLIGGSPNSGKLLHSKNVSAEEEFLLITQSPTGYYRNTVDLTAFYQQ

SEQ ID NO: 8063 - protein, 1358 aa, unidentified
  REGION 1..1358: note = Description of Unknown:uncultivated organism sequence
MDKKYYIGFDIGTESVGWAATDEEYNLLKARGHDFWGTYLFDQAKTAAERRGYRTSRRRFARRRQRIKLLQEIFAQEIAKEDFCFFERLNNSKYNVEDKAENVKYSDSLFHDEIFNDKEYFKKYKTIYHLRKAFLDAESAAEIKDVRLLYLAVAHIIKNRGHFLFEGQEFNAGDKDLAIRAFENVNAALCNMDEDKQSLSLDKLDDVFDALRDKKSTKRDKVKKLKELLDVQKDKTCQEIVNAIVGCKAKTANLFGEGEYEIKDFCFDDGGFELEKVQNAFSEEEFGMICNLKAIYDWAVLAQILGDHQYISQAMCAKFDSHCEDLKMLKDYVKREFGQAKYNEVFRKHEKIDNYTAYVRHDEKRNSSAHHASKEDFYKYLKSFVKDETILAKIEEGVFLEKQRTNANGVIPYQVHKAELELILDNASANFPFLNEESDKMTVKDKIVKLLTFRIPYYVGPLNTAHAEKGFAWVKKFDGTEHEKVTPWNFDKIVDRQASEDEFIKRMTNKCTYLVGEDVLPKQSLLYSEFAFLNSLKNVSFKGRRLDKQARDAIVDFAKRNGKRNITLKVVGNVLAKAGLIEQSENKVENFAGIDKEIKNGFSTLCTFRRIFGDKFDADKCEEIIKWSTIMGNQEDATKRAAREFGLDKEIVKQLKGLNFSGWGNLSKRFLDSDDISVVTQDGEILTLIEAMRETDYNLMELLSKQFGFSAAVDRFNAQNADDEAVTYKTVEDLYCSPSVKRAIWRTVCLAREIEKVQGCPPDRIFVEMTRGGDERKKGARTKTRKEQLTELYKVCKTDVRDWVSQDEVFDLTKQIENTDDAKFLSDKLYLYYLQMGRCAYTGKPIHIEDLLTKNTCDIDHIYPQSKRKDDSVLNNKVLCYKTTNSDKKDVYPIDADIRKNMLPLWTLWHDKKLINDEKFKRLTRCTPLTQEELADFINRQLVETSQSTKAVAQLLKQMYPDSVIVYSKAKNVTEFKNYINSKGNKNGEKNPPKIVKVRELNDLHHAKDAYLNIVVGNVYYSKFNRDALTYLKENGVDSYNLNKLFDENLKKGWNPLMADKVVATVNKNTCKVVRFTSEGKGGLFNATIKVKGANDKLIPLKRNCPLEKIDKYGGYDSATTAYFALVKSADKKGQPQLSLEAIPIYVDLLGEDKVLDYLKNNVALVDPQVLIEKIKINSLLKINGAYVWLRGKTGAQIVLCNANELILDHESVCYLKRIVSFRNKGKKWNVQIIPTVEFDGITKEDNIRLYDVFVEKLLSTPYSNISSFRQQADLLQTNRNIFVELCEMDQIEVLAEVLHFMQCNSVLSKLTLIGGSPNSGKLLHSKNVSAEEEFLLITQSPTGYYRNTVDLTAFYQQ

SEQ ID NO: 8064 - protein, 1329 aa, unidentified
  REGION 1..1329: note = Description of Unknown:uncultivated organism sequence
MKNYYVGIDMGTNSVGWAATDCEYPLLKARGQDLWGSYLFDEAEGAQKRRSFRTARRRTARTRQRLLLLQSLFQEEMAKKDPLFFIRLNNSPLVLKDKNESLKTSDSLFADQSFTDKNYFKKYPTIYHLRASLINDKITDVRLLYLAVHHIIKNRGHFLFESQNFNVANEEVVKDKFFAINAFLSDREMPTLNLERLHEVLQVLKQTKSSKRDKQKTLGELLGVSKEKPLTSIVKALIGGTVSLKDLYSAESDFDDIKSFCFDKASFEDSDLPAIKSAVGEDDAELVLLLKSVYDWTVLCGIMGDEEYISFAKVKIYNKHKSDLVWLKNYVRQNFSKETYNEVFRRKDKKNNYAAYIGMDKQKGFSKCKQEDFYAFLKKRLNITDETVLAEMDKGQFLPKQVIKTNGVVPYQLHLLELKAILRNAQKYFSFLSEKQEGVTVAEKIVSLMTFRIPYYVGPLNTASKKYAWAVRRPGYENVSITPWNFHQIVDSDASEEQFIRRMTNKCTYLVGQDVLPANSLLYSEYVFLNELNNLRINGEKNNKARQLIFHYAKQHKRVTLKNCLALLVRNGLLPADSSTDVFSGLDGDFKTSLSTWYDFRFLGDRLQTQREMCEQIILWITLISDKNRLEKRIRTAYGQYLSDEEIKRIKGFNYSKWGRLSKILLDGIVSERCFDENGELLTIIEAMRQKGENFMQLLSDKYGFQDAIERYNQENSPSDDKVSYQTVEDLYCSPSVKRAIWRTVEIVREIVKIQGCAPQKLFLETARETKDNGKAGKRTVSRKQQLLDLYKDIHLQQHDWIKEIESLPDSKFNSDRLVLYYRQLGRSMYSGKPIKLEEVFDRNICDIDHIYPQSKIKDDSLDNRVLVYKNENSVKSDKYPISSEVRNAMRPFWQSLWVQGLISERKYQRLIRSTPLTVDELADFINRQLVITRQSTKATAQILKQMLPDTEIVYTKAANANEFKDKNNLLKVRELNDLHHAKDAYINIVVGNVYNTKFNHNAAVFFRNNSIDSYNFNKLYESDIPGAWRVAQKADVLATFQKNTCKVVRMTVNGHGALFDVNPVVAGKNADLVPLKKHGAIADTSRYGGYNSAKTAYFVLVRSDGKAGKQLLSLEQWPLWMEKQTGGSTEAKLNYFSQKLTNPKICIDGIKQNTLLCVNGSYAWLKGKTGNAISLCNANQLFLDGENVQTLKLISNYMRDRKTFNNPQMPANEKITAENNLRLYDALVQKLSSSLYAGLAICGQVPFLKEKRPVFASLSVEKQCCVLWEVLRLMQCNVGLSDFTLLGGVANAGVTTINKFIQDKNIKLIFQSPTGYYRTVVDVGRFLK

SEQ ID NO: 8065 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDNDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKRISNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFKRFL

SEQ ID NO: 8066 - protein, 1342 aa, unidentified
  REGION 1..1342: note = Description of Unknown:uncultivated organism sequence
MDKKYYIGFDIGTDSIGWATTDAEYNLLKTRGQDFWGVYLFDEAKTSETRRASRTSRRRTARRRQRINLLQELFAQEIAKADFCFFERLNNSKYNVKDKNDGVAYRDCLFHDEAFGDKEYFKKYPTIYHLRAAFLNEQKAKEIKDVRLLYLAVAHIIKNRGHFLFEGQQFSVGNKDVVLTAFSEINEILTSIDENAKTLSLANVDDALKVLCDGKSAKSDKERRLKLLFETENDKTCVAIIKAIVGLQVNVKNLFGEEEPQIKNFCFDDAGFEIEKLKDAFGEDEYALICEAKAIYDWAVLSQILKNHKYLSEAMCEKYDTHAADLELLKTYVKENFGQEKYREVFRLCKNVNNYAAYVGKDRNRSFCHVSKDDFYKYLRSFVTDEEILKRMNEGTFLQKQRSNANGVIPYQVQLAELERILNNASDNFPFLNDVSDGMSVKEKICSLLTFRIPYYVGPLNTAHTDKGFAWVKKYDGTGNVKITPWNFDKVVDKQASEDEFIKRMTSKCTYLVGEDVLPKQSLLYSEFAFLNELNNVTFKGRRLDKQAREAIVEYAKNNNRKITLKVIADVLAKAGLIEQSEKAKENFAGIDGEIKSGFSTLRFFKRLFGDNFNREQCETIVRWFTVMGNKSDAAERARREFKFDEATTKQLKGLNCSGWGRLSKEFLDGNEITTVDENGEILTIIQAMRETGCNLMELMSSKFGFESSVNRFNDQYAGDKKVTYKTIEDLYCSPSVKRAIWRTVCLAKEIEKVQRCAPSRIFIEMARGEDKSKKGVRTKSRKEQLLELYKACKTDVQQWVTQEFIDALENVEDTKLLSDKLYLYYIQMGRCAYTGRPISIEEVFNTNVCDIDHIYPQSKIKDDSIINNKVLCYKTANAAKGDGYPVAYEIREKMLPIWTVWHNKQFISDEKFKRLTRSTPLCVDELADFINRQLVEIRQSTKAVAQILKRMYPNADVVYSKASNVVDFKNRINKNRPVLVKVREINDLHHAKDAYLNVVVGNVYYTKFNRNAAIFFKNNNADSYNMNRLFEENIKNAWNPSYKQKVVSVANRNICKVVRFTSEGEGKLFDATVKTKGANDKLIPLKRNCPLENTADYGGYDNATTAYFSLVRSVGKKGKTLLSIEAIPVYVDLLGKNKVFDYLENTVGLEQPQVLIEKIKINSLLKLNGAYVWLRGKTNDSLTICNANQMVLDSEMTAYLKRIVSYNEKRKKNKDVTVDETYDKISKTGNLTLYNALLNKLTSHPYINFSALQKQAEFLNEKWDVFCELSVENQCTLLLEILHLMQCNSTSSNLTLIGGGSRAGVLTCNKKLSENGECLLITQSPTGYYKNIVNLTAYYRQ

SEQ ID NO: 8067 - protein, 1349 aa, unidentified
  REGION 1..1349: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKRTLPLAKYAEIADVLKNRKAGKNAREAQLKKICDVDKADKTALAVIRCIVGKKVDLKDLFGENHSVAKEKLCFDDVNFDKNYETLQLQLNDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFETTKITPWNFDKIIDRDASEDKFISRMTNKCTYLLGEDVLPKSSLLYSEFTFRNELNNLCFKDNRLSEKEREEIFKYATEHKRVTLSGIGKLLEEKNLIECGEGKPENFSGTDGDFHSSLSSLITIKRVLGENFDRDMAEQIILWATLTPDKDRLVRRVKNHYSLPDDVLKKIKGLSFSGWGRLSEKFLTDIWAADDDGVRMNIIEAMKSTGANLMELLSAKYGFSDAIKEFNADLNPSPNVEYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQDIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDKPELSIVKIRELNDLHHAKDAYLNIVVGNVYFTKFNRNAAIFFKKNNIDSYNLKNLFNYDLPGAWKVSEKERILQTARKNTCRVVQFVSEERGQLFNDNISPQDTVTKGFVPIKANGPISDMYKYGGYTKVARAYFSLVLSSGNKGKQTITLEAIPIYIDLLGENAVNDYIRRVTGDKNATRLIDKIKMNSLLKIDSTYCYLIGKADERRVLLCNANQFIISDEDAAYLKKISRFCEKNKKAEGKLTADEQHDGLTKDKNLEFYRMLVKRLEEKPYCLLPMPDSTTLLKSKENVFVMLNIEEQCSVIMEIMHFFQCNSVESDLTLLDGKKTGMVRRSKTIDPDEEILLIYQSPTGFYQKTVSLTGFYKA

SEQ ID NO: 8068 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELRKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDDDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLKEEEMKILKRISNYMTDRKLLKRQDLPVGEKIKAEDNVRLYDALVEKLESPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 8069 - protein, 981 aa, unidentified
  REGION 1..981: note = Description of Unknown:uncultivated organism sequence
MDRGKGFAKCNKRDFYDFLKKEVKVKDEKILAKIEAGTFLPKSVSSENCEIPYQVHLAELKAILKNAENFFPFLKQKDESCGLNVCEKIISLMKFRVPYYVGPFTDKETRFSWMIKKEGFEKEKITPWNFDSVVDKDKSEERFIQRMTNFCSYLTGEKVLPAASFLYSEFVFLNELNNLKVNGEKNPRAKEILYELAKREKKLTLKKCRDELVKQGLLPKDSKAQEVFSGTDGDFKSSLSSYIDFKRIIGDKADEYPDMCEQIILWITIISDKKRLEKLIREKYSEFLGEDEIKQIKSLNYTKWGRLSAKLLSGIYETDSDGEVGDRSIIERLREGTDNFMQLLSDGYGYKRSIDLANDDSSVDDRVTYRAVDELYCSPAVKRSIWSAVKIVREIIKVQGKAPEKVFVEMTREVKDGSKKGARTVSRKQELLKLYKENCKKEKELIKQLESADDIKFNSDKMFFYFTQMGRDIYTGEKIGFDDVFNTRLYDIDHIYPRSKIKDDSLNNRVLVSKKVNQSEKRDVYPLPGEMRSKMVDFWLELKEKKLISEEKYYRLMRSAPLTVSECEGFVNAQLVATSQSTKAAAQLLRRMLPGTEVVYSKAGNVNEFKDRLKFVKVRELNDLHHAKDAYFNIVVGNVFNTKFNHDAAVFFKDNGVGNYDFERIYDFDVKDAWKRGDENRIRSVAEKNTCRVVRFSKEEKGQLFKAKICPAGKNANLIPVKGKGPLTDTGKYGGYDSVKVAYFMLVKSKDKKGKALLSLECVTVLANKKFRTLEDKLKYCETELDLKEPEILIEKIKINTLFRINGSYAWIRGKTGRKLILCNANQLLLDNGSVKYLKKITNYFKDVEKYKNDYKNKNKDLPVKEEINARENLALYDLLTEKLGSKTYAGLSCGGRAKTLKAGRNKFEELSLEKQCYVLMEVLKFMTCNREESDITLVGGSKNAGKNTLNKKIDQESDVKIIFCSPTGYFRSVVDLKSFL

SEQ ID NO: 8070 - protein, 1356 aa, unidentified
  REGION 1..1356: note = Description of Unknown:uncultivated organism sequence
MDKKYYIGFDIGTESVGWATTDEEYNLLKARGHDFWGTYLFDQAKTAAERRGYRTSRRRFARRRQRIKLLQEIFAQEIAKVDFCFFERLNNSKYNVEDKAENVKYSDSLFHDEIFNDKEYFKKYKTIYHLRKAFLDAESAAEIKDVRLLYLAVAHIIKNRGHFLFEGQEFNAGDKDLAIRAFENVNAALCDMDEDKQSLSLDKLDDVFDALRNKKSTKRDKVKKLKELLGVQKDKTCQEIVNAIVGCKVKTANLFGEGEYEIKDFCFDDGGFELEKVQNAFSEEEFGMICNLKAIYDWAVLAQILGDHQYISQAMCAKFDSHCKDLEMLKDYVKSEFGQAKYNEVFRKQKDLKNYAAYIGKDRNQSFNHASKEDFYKYLKSFVKDETILAKIEEGVFLEKQRTNANGVIPYQVHKAELELILENACVNFPFLNEESDGMTVKDKIVKLLTFRIPYYVGPLNTAHAEKGFAWVKKFDGTEHEKVTPWNFDKIVDRQASEDEFIKRMTNKCTYLVGEDVLPKQSLLYSEFVFLNSLKNVSFKGRRLDKQARDAIVDFAKRNGKRNITLKVVGNVLAKAGLIEQSENKVENFASIDKEIKNGFSTLCTFRRIFGDKFDADKCEEIIKWSTIMGNQEDAAKRAAREFGLDREIVKQLKGLNFSGWGNLSKRLLDSDDISVVTQDGEILTLIEAMRETDYNLMELLSKQFGFSAAVDRFNAQNADDVAVTYKTVEDLYCSPSVKRAIWRTVCLAREIEKVQGCPPDRIFVEMTRGGDERKKGARTKTRKEQLTELYKVCKTDVRDWVSQDEVFDLTKQIESTEDAKFLSDKLYLYYLQMGRCAYTGKPIHIEDLLTKNTCDIDHIYPQSKCKDDSVLNNKVLCYKTTNSDKKDVYPIDADIRKNMLPLWTLWHDKKLINDEKFKRLTRCTPLTQEELADFINRQLVETSQSTKAVAQLLKQMYPDSVIVYSKAKNVTEFKNYINSKGNKNGEKNPPKIVKVRELNDLHHAKDAYLNIVVGNVYYSKFNRDALTYLKENGVDSYNLNKLFDEKLKKGWNPLMTDKVVATVNKNTCRVVRFTSEGKGGLFNATIKVKGANDKLIPLKRNCPLEKIDKYGGYDSATTAYFALVKSADKKGKPQLSLEAIPIYVDLLGKDKVLDYLKNNVALVNPQVMIEKIKINSLLKINGAYVWLRGKTGDRVVLCNANELILDHGSACYLKKVSAFIAKQKKMRESLVPTAEFDEITKENNMVLYDKLLEKISNAPYSNLPTFIQQSAFLEEKRERFGELSERDQISVLTEVLHFVQCNSVLSNLSILGGVQHAGLLLRSKKIASDEEFLLITQSPTGYYRSTVDLTAFYQQ

SEQ ID NO: 8071 - protein, 1356 aa, unidentified
  REGION 1..1356: note = Description of Unknown:uncultivated organism sequence
MDKKYYIGFDIGTESVGWATTDEEYNLLKARGHDFWGTYLFDQAKTAAERRGYRTSRRRFARRRQRIKLLQEIFAQEISKVDFCFFERLNNSKYNVEDKAENVKYSDSLFHDEIFNDKEYFKKYKTIYHLRKAFLDAESAAEIKDVRLLYLAVAHIIKNRGHFLFEGQEFNAGDKDLAIRAFENVNAALCDMDEDKQSLSLDKLDDVFDTLRDKKSTKRDKVKKLKELLGVQKDKTCQEIVNAIVGCKAKTANLFGEGEYEIKDFCFDDGGFELEKVQNAFSEEEFGMICNLKAIYDWAVLAQILGDHQYISQAMCAKFDSHCKDLKMLKDYVKSEFGQAKYNEVFRKQKDLKNYAAYIGKDRNQSFNHASKEDFYKYLKSFVKDETILAKIEEGVFLEKQRTNANGVIPYQVHKAELELILENACANFPFLNEESDGMTVKDKIVKLLTFRIPYYVGPLNTAHAEKGFAWVKKFDGTEHEKVTPWNFDKIVDRQASEDEFIKRMTNKCTYLVGEDVLPKQSLLYSEFAFLNSLKNVSFKGRRLDKQARDAIVDFAKRNGKRNITLKVVGNVLAKAGLIEQSENKVENFAGIDKEIKNGFSTLCTFRRIFGDKFDADKCEEIIKWSTIMGNQEDVAKRAAREFGLDKEIVKQLKGLNFSGWGNLSKRFLDSDDISVVTQDGEILTLIEAMRETDYNLMELLSKQFGFSAAIDRFNAQNADDGAVTYKTVEDLYCSPSVKRAIWRTVCLAREIEKVQGCPPDRIFVEMTRGGDERKKGARTKTRKEQLTELYKVCKTDVIDWVSQDEISDLTKQIESTEDAKFLSDKLYLYYLQMGRCAYTGKPIHIEDLLTKNTCDIDHIYPQSKRKDDSVLNNKVLCYKTTNSDKKDVYPIDADIRKNMLPLWTLWHDKKLINDEKFKRLTRCTPLTQEELADFINRQLVETSQSTKAVAQLLKQMYPDSVIVYSKAKNVTEFKNYINSKGNKNGEKNPPKIVKVRELNDLHHAKDAYLNIVVGNVYYSKFNRDALTYLKENGVDSYNLNKLFDEKLKKGWNPLMTDKVVATVNKNTCRVVRFTSEGKGGLFNATIKVKGANDKLIPLKRNCPLEKIDKYGGYDSATTAYFALVKSADKKGKPQLSLEAIPIYVDLLGKDKVLDYLKNNVALVDPQVMIEKIKINSLLKINGAYVWLRGKHDDARIKICNANELILDHNCSCYLKKIISFMQKQKKLGVEFEPMLEIDLISAQMNLVLYDSFVNKLGNAPYGNLPMMENYYKLMCDGRDVFTAMNMKQQVILLSQILKLFQCNPVEADLTSIGGRSAGALRRSKKIALDEEFLLITQSPTGYYRDTVDLTAFYQQ

SEQ ID NO: 8072 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDDDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKRISNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 8073 - protein, 1347 aa, unidentified
  REGION 1..1347: note = Description of Unknown:uncultivated organism sequence
MRENYYVGLDIGTDSVGWAVTDRQYNLLRAKGKDMWGAYLFDLAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKRTLPLDKYAEIADVLKNRKTGKNAREAQLKKICDVDKADKTALAVIRCIVGKKVDLKDLFGENHSVAKEKLCFDDVNFDKNYETLQLQLSDEEAAFVDAMKAVYDWAMLAEVLNGNTYLSLAMIERYRIHAEHLKMLKSYIKSECPERYAQTFRRNSRNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFETTKITPWNFDKIIDRDASEDKFISRMTNKCTYLLGEDVLPKSSLLYSEFTFRNELNNLCFKDNRLSEKEREEIFKYASEHKRVTLSGIGKLLENNNLIERGEGKPENFSGTDGDFHSSLSSLITMKSVLGEYFDRDMAEQIILWATLTPDKDRLVRRVKSHYSLPGDVLKKIKGLNFSGWGRLSEKFLTDIWAADDDGVRTNIIEAMKSTGANLMELLSAKYGFSDAIKDFNADLNPSPNVQYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQHIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKRLFDYDLPGAWKVSEKERILQTARKNTCRVVRFVSEGRDGLFNATIKPKGANDKLIPLKANGPLADTDKYGGYDSASTAYFALVSSIGKKNEKTITLEAIPIYIDLLGENAVNDYIKRITGDKNATVLIEKIKLNSLLKICGSYCYLRGKTGSQILLCNANQFIISDENAAYLKKISRFCEKNKKAEGRLTADEQHDGLTKEKNLEFYRMLTDRLCSAPYSALLGQQAPGLREKESVFMGLTIEAQCSVIMEVMHFFQCNSVTSNLQAIGGVPQAGKIYNNKKLSEYEEILLIYQSPTGFYQKTISLTGFYKA

SEQ ID NO: 8074 - protein, 1349 aa, unidentified
  REGION 1..1349: note = Description of Unknown:uncultivated organism sequence
MRENYYVGLDIGTDSVGWAVTDRQYNLLRAKGKDMWGAYLFDPAKTAAKRRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKHTLPLAKYAEIADVLKNRKTGKNAREAQLKKICDVDKADKTALAVIRCIVGKKVDLKDLFGENHSVAKEKICFDDTDFDKNYETLQLQLNDEETAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVQDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKAREEIFKYATEHKRVTLSGIGKLLEEKNLIECGEGKPENFSGTDGDFHSSLSSLITIKRVLGENFDRDMAEQIILWATLTPDKDRFVRRVKNHYSLPDDVLKKIKGLSFSGWGRLSEKFLTDIWAADDDGVRTNIIEAMKSTGANLMELLSAKYGFSDAIKEFNADLNPSPNVEYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQHIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDKPELSIVKIRELNDLHHAKDAYLNIVVGNVYFTKFNRNAAIFFKKNNIDSYNLKNLFNCDLPGAWKVSEKERILQTARKNTCRVVQFVSEERGQLFNDNISPQDTVTKGFVPIKANGPISDMYKYGGYTKVARAYFSLVLSSGNKGKQTITLEAIPIYIDLLGENAVNDYVKKVTGDKNATRLIDKIKMNSLLKIDSTYCYLIGKADERRVLLCNANQFIISDENAAYLKKISRFCEKNKKAEGRLIADEQHDGLTKDKNLEFYRMLVKRLEEKPYCLLPMPDSTTLLKSKENVFVMLNIEEQCSVIMEIMHFFQCNSVESDLTLLGGKKTGMVRRSKTIDPDEEMLLIYQSPTGFYQKAISLTGFYKA

SEQ ID NO: 8075 - protein, 1366 aa, unidentified
  REGION 1..1366: note = Description of Unknown:uncultivated organism sequence
MVVNHFINIISQKKGEVKQMRENYYVGLDIGTDSVGWAVTDRQYNLLRAKGKDMWGAYLFDPAKTEAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFFDDDLSEDNKRTLPLAKYAEIADVLKNRKTGKNAREAQLKKICDVDKADKTALAVIRCIVGKKVDLKDLFGENHSVAKEKLCFDDVNFDKNYETLQLQLSDEEAAFVDAMKAVYDWAMLAEVLNGNTYLSLAMIERYRIHAEHLKMLKSYIKSKCPERYAQTFRRNSSNNYAAYVGSDRGRDFKHCTREDFYKYLRSFVKDEQILQLTERGEFLPKLRTSVNGVIPYQVHRAELVTILKNAEDNFPFLKEEQDGFTVAQKIIKLLEFRIPYYVGPLSSAHESKNPKKGFYWAVKNPGFETTKITPWNFDKIIDRDASEDKFISRMTNKCTYLLGEDVLPKSSLLYSEFTFRNELNNLCFKDNRLSEKEREEIFKYATEHKRVTLSGIGKRLENNNLIERGEGKPENFSGTDGDFHSSLSSLITMKRVLGEYFDCDMAEQIILWATLTPDKDRLVRRVKSHYSLPDDVLKKIKGLNFSGWGRLSEKFLTDIWAADDDGVRTNIIEAMKSTGANLMELLSAKYGFSDAIKEFNVDLNPSPNVKYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQHIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKNHDKPELSIVKIRELNDLHHAKDAYLNIVVGNVYFTKFNRNAAIFFKKNNIDSYNLKRLFDYDLPGAWKVSEKERILQTARKNTCRVVRFVSEEHGKLFDATIKPKGANDKLISLKANGPLADTDKYGGYDSASTAYFALVSSIGKKNEQTITLEAIPIYIDLLGENAVNDYIKRITGDKNATVLIEKIKLNSLLKICGSYCYLRGKTGSQILLCNANQFIIPDEDAAYLKKISRFCEKNKKAEGKLTADEQHDGLTKEKNLEFYRMLTDRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 8076 - protein, 647 aa, unidentified
  REGION 1..647: note = Description of Unknown:uncultivated organism sequence
MELLSAKYGFSDAIKDFNADLNPSPNVQYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKKYNQDIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKRLFDYDLPGAWKVSEKERILQTARKNTCRVVRFVSEEHGKLFDATIKPKGANDKLIPLKANGPLADTDKYGGYDSASTAYFALVSSIGKKNEKTITLEAIPIYIDLLGENAVNDYIRRVTGDKNATVLIEKIKLNSLLKICGSYCYLRGKTGSQILLCNANQFIISDENAAYLKKISRFCEKNMKAEGRLTADEQHDGLTKEKNLEFYRMLADRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 8077 - protein, 690 aa, unidentified
  REGION 1..690: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKHTLPLDKYAEIADVLKNRKTGKNAREAQLKKICDLDKADKTALAVIRCIVGKKVDLKDLFGENHSVAKEKLCFDDTDFDKNYETLQLQLSDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKEREEIFKYASEHKRVTLSGIGKLLENKNLIERGEGKPENFSGTDGDFHSSLSSLIIMKRVLGEYFDRDMAEQIILWATLTPDKDRLVRRVKNHYSLPDDVLKKIKGLSFSGWGRLSEKFLTDIWAADDDGVRTNII

SEQ ID NO: 8078 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDNDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKSVSNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFEKFL

SEQ ID NO: 8079 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKHTLPLDKYAEIADVLKNRKTGKNAREAQLKKICDLDKADKTALAVIRCIVGKKVDLKDLFGENHSVAKEKLCFDDTDFDKNYETLQLQLSDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKEREEIFKYASEHKRVTLSGIGKLLENKNLIERGEGKPENFSGTDGDFHSSLSSLIIMKRVLGEYFDRDMAEQIILWATLTPDKDRLVRRVKNHYSLPDDVLKKIKGLSFSGWGRLSEKFLTDIWAADDDGVRTNIIEAMKSTGANLMELLSAKYGFSDAIKDFNADLNPSPNVQYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKKYNQDIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKRLFDYDLPGAWKVSEKERILQTARKNTCRVVRFVSEEHGKLFDATIKPKGANDKLIPLKANGPLADTDKYGGYDSASTAYFALVSSIGKKNEKTITLEAIPIYIDLLGENAVNDYIRRVTGDKNATVLIEKIKLNSLLKICGSYCYLRGKTGSQILLCNANQFIISDENAAYLKKISRFCEKNMKAEGRLTADEQHDGLTKEKNLEFYRMLADRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 8080 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDDDFKRSLKSYNDLSFLGEKRYTRSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLKGEEMKILKRISNYMTDRKLLKRQDLPVGEKIKAEDNVRLYDALVEKLESPVYRGLSIRKQAEFLKKSRERFISLSLEKQCVVIFEVLHLMQCNSVTADLTLLGGVPNAGSLVSSKFVQDNEMKIIYQSCTGYYREIIDFKRFL

SEQ ID NO: 8081 - protein, 1328 aa, unidentified
  REGION 1..1328: note = Description of Unknown:uncultivated organism sequence
MGKNYYIGIDMGTDSVGWAVTDEEYRLLKSKGRDLWGSYLFEEAQAAAQRRSFRTARRRTARTRQRLLLLQSLFAEEMAKVDPLFFLRLNNSSLFLQDKDGKLRCSDALFGDPSYRDKDYFAEYPTIYHLRAALLQGEVKDIRLLYLAIHHIIKNRGHFLFESQSFSVGDTQTVREKFTAINAFLSDREMPTLELSALSEGLEVLRNSRIGKRDKQLRLKDIFKTGGEKSLIALVKALTGGSVNLKELYCAEESFADVSVFSFEKASFDETDLPAIENAVGQEEAELVLLLKSVYDWSVLCAIMGEEQFISLAKKKIYEKHKADLCRLKEYIRKNCPEKYADVFRRREKKSNYAAYIGMDKQKGCAKCKRGDFYAFLKKEIKIEDEYILTEIEKGEFLPKQVSDANGVIPYQVHLLELKAILANAAGKFPFLTDERDGSTVAEKIISLMTFRIPYYVGPLHTQSPFAWAVRKSGYERTSVTPWNFDSVIDADASEEQFIRRMTNKCTYLAGQDVLPANSLLYSEFTFLNELNNLRVNGVKNDAARKLIYEYAKQHKKVTLKNCLALLIREGLLPVGSRAEETFSGIDGDFKTSLAPWYDLRFLGNKIETHREMCEEIIIWITLISDKERLEKRIRRAYGTILSDEEIKRFKGLNYSKWGRLSAVLLDGIVSPRCADENGEPLTIIRAMRATGENFMQLLSAKYGYQEAIDAYNAENAPRGKVTYKTVEDLYCSPSVKRAIWRTVELVREIAKICGGAPKKLFIETVREVNDDRRGQRTVSRKQQLIDLYKNIKKEERDWIAEIENTADKKFDSDRLVLYYRQLGRSMYSQKPIRLEDVFDTNICDIDHIYPQSKIKDDSLDNRVLVFKTENTAKGDRYPLSADVREKMISFWRELKDRALIGEKKFERLTRTTALTQEELADFINRQLVSTSQSTKAAAQILGEIFPDTEIVYAKAGNANRFKDENKIVKVRELNDLHHAKDAYVNIVVGNVYNTKFNHNAAVYFRDHGVDSYNLKNLFTHDIPGAWKVSEKERILQTVAKNTCRVVRMTENGKGKLFDIQPKSAGKNADLIPLKICGAISDTAKYGGYDSATTAYFMLVRSKGKKGKVALSLEAYPLWLDKRGGGAKEDKLRFCVERAGLKEPEIIVDNIKLNTLFCIDGSYAWLRGKTGNRVVWCNANELFLDEESMRTLKNISNYMRDRKRLNKPDLCAGDKITAECNIRLYDALVEKLGSSVYAGLSVKGQVPFLRGKREAFAELSREDQCKIIFEVLHLMQCNSVLSDFSSLGGVAHAGSILSNKFVQDMDIKMIFQSPTGYYRRVVDLKEFI

SEQ ID NO: 8082 - protein, 1170 aa, unidentified
  REGION 1..1170: note = Description of Unknown:uncultivated organism sequence
MSAINAYFSDDELSEDNKRTLPLAKYAEIADVLKNRKTGKNAREAQLKKICDVDKADKTALAVIRCIVGKKVDLKDLFGENHSVAKEKLCFDDTDFDKNYETLQLQLNDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKAREEIFKYATEHKRVTLSGIGKLLEEKNLIECGEGKPENFSGTDGDFHSSLSSLITIKRVLGENFDRDMAEQIILWATLTPDKDRLVRRVKSHYSLPDDVLKKIKGLSFSGWGRLSEKFLTDIWAADDDGVRTNIIEAMKSTGANLMELLSAKYGFSDAIKEFNADLNPSPNVEYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQDIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDKPELSIVKIRELNDLHHAKDAYLNIVVGNVYFTKFNRNAAIFFKKNNIDSYNLKRLFDYDLPGAWKVSEKERILQTARKNTCRVVQFVSEERGQLFNDNISPQDTVTKGFVPIKANGPISDMYKYGGYTKVARAYFSLVLSSGNKGKQTITLEAIPIYIDLLGENAVNDYVKNVTGDKNATRLIDKIKMNSLLKIDSTYCYLIGKADERRVLLCNANQFIISDEDAAYLKKISRFCEKNKKAEGRLTADEQHDGLTKEKNLEFYRMLVKRLEEKPYCLLPMPDSTTLLKSKENVFVMLNIEEQCSVIMEIMHFFQCNSVESDLTLLGGKKTGKVRRSKTIDPDEEILLIYQSPTGFYQKTISLTGFYKA

SEQ ID NO: 8083 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRRILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDNDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKRISNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFEKFL

SEQ ID NO: 8084 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFETQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDDDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIFQIVEKNTAKAIRMTLSGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKRISNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 8085 - protein, 949 aa, unidentified
  REGION 1..949: note = Description of Unknown:uncultivated organism sequence
MPKLRTSVNGVIPYQVHRAELVTILKNAEDNFPFLKEEQDGFTVAQKIIKLLEFRIPYYVGPLSSAHESKNPKKGFYWAVKNPGFETTKITPWNFDRIIDRDASEDKFIGRMTSKCTYLLGEDVLPKSSLLYSEFTFRNELNNLCFKDNRLSEKAREEIFKYATEHKRVTLSGIGKLLEENNLIECGEGKPENFSGTDGDFHSSLSSLITMKNVLGEYFDRDMAEHIILWATVTPDKDRLVRRVKNNYSLPEDVLKRIKGLTFSGWGRLSEKFLTDIWAADGDGVRTNIIGAMKSTGANLMELLSAKYGFSDAVNAFNADNTPSSDVGYPDVDELYCSPSVKRAIWRTICLVREIEKINGCPPKRIFVEMARGATEDQKGKRTTSRKEQIKALFKDIRDNERDWMAEIETQPDSVFSSDKMFMYYMQMGKCAYSGKNIPLNEVFNTNIYDIDHIYPQSKIKDDSLDNRVLCSKEYNQHIKKDVYPVPKEIRDNMRDIWAVWLDKKLISKEKYKRLTRSTPLTEAELSDFIDRQLVETRQSTKAVATLLKRMYPDSEIVYSKAGNVAAFKEKVNNDYKKHDKPELSIVKIRELNDLHHAKDAYLNIVVGNVYFTKFNRNAAIFFKKNGIDSYNLNRLFDCDLPGAWKVSEKERILQTARKNTCRVVRFVSEGRGQLFNDNISPQDTVTKGFVPIKANGPISDMYKYGGYTKVARAYFSLVLSSGKKGKQTITLEAIPIYIDLLGENAVNDYVKKVTGDKNAIRLIDKIKMNSLLKIDGTYCYLIGKADERRVLLCNANQFIISDENAAYLKKISRFCEKNKKAEGKLIADEQHDGLTKDKNLEFYRMLVKRLEEKPYCLLPMPDSTTLLKSKENVFVMLNIEEQCSVIMEIMHFFQCNSVESDLTLLGGKKTGMVRRSKTIDSDEEILLISQSPTGFYQKVISLTGFYKA

SEQ ID NO: 8086 - protein, 1327 aa, unidentified
  REGION 1..1327: note = Description of Unknown:uncultivated organism sequence
MGKNYYIGIDMGTDSVGWAVTDEEYRLLKSKGRDLWGSYLFEEAQAAAQRRSFRTARRRTARTRQRLLLLQSLFAEEMAKVDPLFFLRLNNSSLFLQDKDGKLRCSDALFGDPSYRDKDYFAEYPTIYHLRAALLQGEVKDIRLLYLAIHHIIKNRGHFLFESQSFSVGDTQTVREKFTAINAFLSDREMPTLELSALSEGLEVLRNSRIGKRDKQLRLKDIFKTGGEKSLIALVKALTGGSVNLKELYCAEESFADVSVFSFEKASFDETDLPAIENAVGQEEAELVLLLKSVYDWSVLCAIMGEEQFISRAKKKIYEKHKADLCRLKDYIRKNCPEKYADVFRRREKKSNYAAYIGMDKQKGCAKCKRGDFYAFLKKEIKIEDEYILTEIEKGEFLPKQVSDANGVIPYQVHLLELKAILANAAGKFPFLTDERDESTVAEKIISLMTFRIPYYVGPLHTQSPFAWAVRKSGYERTSVTPWNFDSVIDADASEEQFIRRMTNKCTYLAGQDVLPANSLLYSEFTFLNELNNLRVNGVKNDAARKLIYEYAKQHKKVTLKNCLALLVREGLLPVGSRAEETFSGIDGDFKTSLAPWYDLRFLGNKIETHREMCEEIIIWITLISDKERLEKRIHRAYGTILSDEEIKRFKGLNYSKWGRLSAVLLDGIVSPRCADENGEPLTIIRAMRATGENFMQLLSAKYGYQEAIDAYNAENAPRGKVTYKTVEDLYCSPSVKRAIWRTVELVREIAKICGGAPKKLFIETVREVNDDRRGQRTVSRKQQLIDLYKNIKKEERDWIAEIENTADKKFDSDRLVLYYRQLGRSMYSQKPIRLEDVFDTNICDIDHIYPQSKIKDDSLDNRVLVFKTENTAKGDRYPLSADVREKMISFWRELKDRALIGEKKFERLTRTTALTQEELADFINRQLVSTSQSTKAAAQILGEIFPDTEIVYAKAGNANRFKDENKIVKVRELNDLHHAKDAYVNIVVGNVYNTKFNHNAAVYFRDHGVDSYNLKNLFTHDIPGAWKVSEKERILQTVAKNTCRVVRMTENGKGKLFDIQPKSAGKNADLIPLKICGAISDTAKYGGYDSATTAYFMLVRSKGKKGKVALSLEAYPLWLDKRSSAKEDKLKFCTERIGLKDPEILFDNIKLNTLFCIDGSYAWLRGITGKQLIWRNANELFLDEESMRTLKNISNYMRDRKRLNKPDLRAGDKITAEGNIRLYDALVEKLGSSVYAGLSVKGQEPFLRGKREAFAELSREDQCKIIFEVLHLMQCNSVLSDFSSLGGVAHAGKNFSNKFVQDMDIKMIFQSPTGYYRRVVDLKEFV

SEQ ID NO: 8087 - protein, 1349 aa, unidentified
  REGION 1..1349: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKHTLPLDKYAEIADVLKNRKTGKNAREAQLKKICDVDKADKTALAVIRCIVGKKVDLKDLFGENHSVAKEKLCFDDTDFDKNYETLQLQLNDEETAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVKDEQILQLIERGEFLPKLRTSVNGVIPYQVHRAELVTILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKEREEIFKYATEHKRVTLSGIGKLLEEKNLIECGEGKPENFSGTDGDFHSSLSSLITIKRVLGENFDRDMAEQIILWATLTPDKDRLVRRVKNHYSLPDDVLKKIKGLSFSGWGRLSEKFLTDIWAADDDGVRTNIIEAMKSTGANLMELLSAKYGFSDAIKEFNADLNPSPNVEYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQDIKKDVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDKPELSIVKIRELNDLHHAKDAYLNIVVGNVYFTKFNRNAAIFFKKNNIDSYNLKNLFNYDLPGAWKVSEKERILQTARKNTCRVVQFVSEERGQLFNDNISPQDTVTKGFVPIKANGPISDMYKYGGYTKVARAYFSLVLSSGNKGKQTITLEAIPIYIDLLGENAVNDYIRRVTGDKNATRLIDKIKMNSLLKIDSTYCYLIGKADERRVLLCNANQFIISDEDAAYLKKISRFCEKNKKAEGKLTADEQHDGLTKDKNLEFYRMLVKRLEEKPYCLLPMPDSTTLLKSKENVFVMLNIEEQCSVIMEIMHFFQCNSVESDLTLLDGKKTGMVRRSKTIDPDEEILLIYQSPTGFYQKTVSLTGFYKA

SEQ ID NO: 8088 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDDDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLKEEEMKILKRISNYMTDRKLLKRQDLPVGEKIKAEDNVRLYDALVEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFEKFL

SEQ ID NO: 8089 - protein, 1327 aa, unidentified
  REGION 1..1327: note = Description of Unknown:uncultivated organism sequence
MDKKYYIGADIGTESVGWAVTDEDYNILKARGRELWGSYLFDKAESAAERRLYRNARRRTARVRRRLNLLQELFAEEISKVDPLFFIRLNNSSLFTEDKDGVLTSKDALFADEKFCDKDYFKKYPTIYHLRSGLIKGEVDDIRLFYLAVHHIIKYRGHFLFELQNFSLGNSEIIREKFYLINAFLSDRDMPVLDLSDLDKAIDELKKKEGSKRSRQKLLTDILHTGSEKSLTAVVKAITGGSVKLKELYNIEEDNEKITSFSFEKSTFEDNDMPAIEEAVGIDEAVLVRELKAIYDWSVLCEIMGEETYVSFAKVKIYEKHREDLAWLKRYIRENCPEKYTAVFRNKNGKDNYAAYVGMDKQKRVSKCTREEFYAFLRKEVEITDKKVLAEIERSNFMPKQVSEKNGVIPYQVHLTELRKILDEAEKKFPFLKEKKDGKTVAEKIIMLMTFRIPYYVGPLHTQSDFGWSVRNPGYEKVSITPWNYSEAIDEDASEEKFIRLLTKKCTYLKGEDVLPENSLLYSEFAFLNELNNLRINGEKSEEARRLIYEYAKTHKKVTLKSCLALLIRNGCIPAGSGKEIFSGIDDDFKRSLKSYNDLSFLGEKRYTHSEMCEKIITWLTLISDKHRFEKRLRREYGKILTEEEIKKLKSLNYSKWGRLSEKLLDGITSARCTDENGECLTIIEAMRKKGENFMQLMSDKYGFQDAIREYNSESEQDEKVTYKKVSALYCSPAVKRSIWKTIEIVKEIVKIQGKDPAKVFIEMAREVKDGSMKGSRTVSRKDQLLELYKNIKGEEREWIAEIEQTPDAKFNSDKLVLYYRQLGKSMYSGKDISIDEVFDTNICDIDHIYPQSKIKDDSLDNRVLVYKTENQGKQDKYPIAEDIRVKMTPFWKMLKERKLISDVKFERLIRRTQLTQDELKDFINRQLVFTRQSTKAVAQLLKEMLPDTEIVYAKAGNANDFKSENNIIKIRELNDLHHAKDAYINIVVGNVYNTKFNHSARFYFNERESNDYDLKNLYRRDIPGAWKVADKERIIQIVEKNTAKAIRMTLGGQGRLFDVNPVKAGQNDDLLPLKMKGAISDTSKYGGYNSQKTAYFMLVRSKGKKGKIMLSMEAFPLWMEKQNKAGIEEKVRFCAKQGLVEPEIVIDRIKLNTLLYMDGSYAWLRGKTGNRIKLCNANQLYLNKEEMKILKRISNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFKRFL

SEQ ID NO: 8090 - protein, 1347 aa, unidentified
  REGION 1..1347: note = Description of Unknown:uncultivated organism sequence
MRENYYVGLDIGTDSVGWAVTDRQYNLLRAKGKDMWGAYLFDPAKTAAERRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDDLSEDNKRTLPLDKYDEIADVLKNRKTGKNAREAQLKKICDVDKADKTALAVIRCIVGKKVDLKDLFGENHSVAKEKLCFDDVNFDKNYETLQLQLNDEEAAFVDAMKAVYDWAMLAEVLNGNTYLSLAMIERYRIHAEHLKMLKSYIKSECPERYAQTFRRNSNNNYAAYVGSDRGRDFKHCTREDFYKYLRSFVKDEQILQLIERGEFLPKLRTSVNGVIPYQVHRAELVAILKNAEDNFPFLKEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKEREEIFKYATEHKRVTLSGIGKRLEENNFIECGEGKPENFSGTDGDFHSSLSSLITIKRVLGENFDRDMAEQIILWATLTPDKDRLVRRVKNHYSLPDDVLKKIKGLSFSGWGRLSEKFLTDIWAADDDGVRTNIIEAMKSTGANLMELLSAKYGFSDAIKEFNADLNPSPNVEYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKKYNQDIKKDVYPVSKEIRDKMRDIWAVWLDKKLISKEKYKRLTRSTPLTEAELSDFIDRQLVETRQSTKAVATLLERMYPDSEIVYSKAGNVADFKEKVNNDYKKHDKPELSIVKIRELNDLHHAKDAYLNIVVGNVYFTKFNRNAAIFFKKNNIDSYNLKRLFDYDLPGAWKVSEKERILQTARKNTCRVVRFVSEEHGKLFDATIKPKGANDKLIPLKANGSLADTDKYGGYDSASTAYFALVSSIGKKNEKTITLEAIPIYIDLLGENAVNDYIKRITGDKNATVLIEKIKLNSLLKICGSYCYLRGKTGSQIVLCNANQFIISDENAAYLKKISRFCEKNKKAEGRLTADEQHDGLTKEKNLEFYRMLVSRLCSAPYSALLGQQAPGLREKESVFMGLTIEAQCSVIMEVMHFFQCNSVTSNLQAIGGVPQAGKIYNNKKLSKNEEILLIYQSPTGFYQKTISLTGFYKA

SEQ ID NO: 8091 - protein, 1347 aa, unidentified
  REGION 1..1347: note = Description of Unknown:uncultivated organism sequence
MRENYYVGLDIGTDSVGWEVTDRQYNLLRAKGKDMWGAYLFDPAKTAAKRRGYRTARRRTARVRQRIKLLQELFAPEVYAVDPAFFIRMEQSKFVETDKTIDGKDAIFHDEAFGDKEFYKKFPTIYHLRAAFLDPQQARGITDVRLLYLAIHHIIKNRGHFLFEGQNITAGDTDLLKTSLSAINAYFSDDELSEDNKRTLPLAKYAEIADVLKNRKTGKNAREAQLKKICDVDKADKTALAVIRCIVGKKVDLKDLFGENHSVAKEKLCFDDVNFDKNYETLQLQLSDEEAAFVDAMKAVYDWAMLAEVLNGNTYLSLAMIERYRIHAEHLKMLKSYIKSECPERYAQTFRRNSSNNYAAYVGSDRGRDFKHCTREDFYKYLRSFVKDEQILQLIERGEFLPKLRTSVNGVIPYQVHRAELVTILKNAEDNFPFLQEEQDGFTVAQKIIKLLEFRIPYYVGPLSSAHESKNPKKGFYWAVKNPGFERTKITPWNFDKIIDRDASEDKFISRMTNKCTYLLGEDVLPKSSLLYSEFTFRNELNNLCFKDNRLSEKEREEIFKYATEHKRVTLSGIGKLLENNNLIECGEGKPENFSGTDGDFHSSLSSLITIKRVLGEYFDCDMAEQIILWATLTPDKDRLVRRVKSHYSLPDDVLKKIKGLSFSGWGRLSEKFLTDIWAADDDGVRTNIIEAMKSTGANLMELLSAKYGFSDAIKDFNADLNPSPNVQYSDVDELYCSPSVKRAIWRTICLVREIEKINGCPPKRIFVEMARGATKEQKGKRTTSRKEQIKALFKDIHDNERDWVAEIESQPDNLFSSDKMFMYYMQMGKCAYSGENIPLTDVFNTNLYDIDHIYPQSKIKDDSLDNRVLCKKEYNQDIKKNVYPVSKEIRDKMRDIWAVWLDKKLISKEKYKRLTRSTPLTEAELSDFIDRQLVETRQSTKAVATLLKRMYPDSEIVYSKAGNVADFKEKVNNDYKKHDEHRIALVKVRELNDLHHAKDAYLNIVVGNVYFTKFNRNAAIFFKKNNIDSYNLKRLFDYDLPGAWKVSEKERILQTARKNTCRVVQFVSEGRDGLFNATIKPKGANDKLIPLKANGPLADTDKYGGYDSASTAYFALVSSIGKKNEKTITLEAIPIYIDLLGENAVRDYIKRITGDKNATVLIEKIKLNSLLKICGSYCYLRGKTGSQILLCNANQFIIPDEDAAYLKKISRFCEKNKKAEGKLTADEQHDGLTKEKNLEFYRMLADRLCSAPYSALLGQQAPGLREKESVFMGLTIEAQCSVIMEVMHFFQCNSVTSNLQAIGGVPQAGKIYNNKKLSEYEEILLIYQSPTGFYQKTISLTGFYKA

SEQ ID NO: 8092 - protein, 1337 aa, unidentified
  REGION 1..1337: note = Description of Unknown:uncultivated organism sequence
MERNNNSEITLGLDLGVGSIGWTILKTSEKNGQKTNEVLKTGVELFPEVKSAKERREKRGARRLIRRRKLKLSKLRTMIMNFCDENNNNLFGYKSKEELENDLSSSGFIKINEAQKIYILDIIDEEMKNINKQYDSNFIQKLFFNSQDLSGFNEFLNEYKNNIQLLRLLFINLLLQKEFDINKPSTNTIYFRKIAIKLIYDLFKNRGVFYDIKISEKTENPTNIEVFPTFEKFKKDVLNSQVKIKWNLKLKDDKFKEVFSNIEWSRELEWILNKVFAENIFSDFKENIKSLFSFTRKYNEGPGSEKSYSTYGIYSKDGEKLYNNIWDKYIKKCSIYNTINGFEDLSVEVILSNNYKIFNTINNLQNILNPEARKLITCEMYENLIKYLANIKKWDKKEANKEIELNIENLITILGLKDKNLTKFDFFDYYLSETIKNDFIDESKLEDLDADDTKKLEKIIDKNTFKFPKFEYANILCKFLGFNFSNIDELLWENKSEEESIFSYFTSLLCRNSDKESRRIQLEKYFEENIDKLLVKEKPIKNNKKVNEVIAAVIALKPKYGNLSSKAINEFNNKILERENNEEILTFSKYREEIIQSVQTKPDNIDIEVFFKTKNLNATTEKTLRIADKLVSKLYKDYKFNNIVIEIARELNKSEKVIKQINKENNVLMEFNKFLLSKYGKNSKKIKLLIEQNGIDLYTGDKILSSFENFNISMLDNYEIDHIIPQSKFYDSRMDNLALTNSTSNKKKSNETAYDYVKNNKSILKKWNDLYKINEEKNNQNKNDNVDYTSFDLLKSLIKDWKETKAKLLIQYFKNIRRKKIRNLLKSGYRIDNTFLRSNLIDTQTITKTACEWFKIKFHDKGIKIIPFKGFATSAVRTYSGLPFKDRNDNIHHAIDSTVISTTYNNSKIFKDLITEENVLGKWEYYSKEKKEVTSAIKEALLDEERKYKEEFLNRVDFKYYPVIKFNKKTTQENIVAVYQQYQNDGTKTIRDLRRSSDIKEIDLATLISFAIQTYHKWKNKENDDLDAPESLIKIYLDVVSKEKNKENKEDKFYFKWIPIWVNDTKFLSQIKVIYDSLIYYLLNKCKHNNHNVSNDCANLVDEYSRCISKHNGIIKDSYIQNKWFVFIPQKYLSKDSKELIVINKLTLFDNSQNRKSSAYINWTKKDKTSRIGNLKEIDENYFGILCIKNKNDNGWKPIILRYDFLKNVSERIELIKILSKIDTHITNNYFLQKINNWITKNIEGFKKFNYIKEDEDIQITKETEVIYLLNKLTYIRKEEKSNSDKSVEQIENKNLFIIKTIEYTDIQVEFSTVREKQVNYKPRLNSVLKEYKRWIK

SEQ ID NO: 8093 - protein, 1259 aa, unidentified
  REGION 1..1259: note = Description of Unknown:uncultivated organism sequence
MTNINFAMNRKILGLDIGVASIGWWLNEITTDECAVLGSGVRIVPLKKDEADNFSKAKTITTTKDRTVARTARKMQHRYKLRKQKLRKIFEKLEMMPTEKEILLSALELYGLRNKAITEQISLQEIGRIFFHLNQKRGYKSSRKAKPEDEKAKEDKTETAPKKNSRKAKNADNTNEITEIDKPTGKPKEKGYLELIADREQVLKDRNLTVGQYFYELLQENELARLKDQIFLRETYHKEFDKIWETQAKFYPQILTKENYKLICDEIIYFQRPLKSQKHLVGKCIFEKSYKTTPRSSPLFQEFVVWQMVNNVEVTQKYGKKNGKKITMDYSLNDKKHLFDYLQRFEKITDKECLELLGYNAKDYQLNYKEIKGNTTLVALAKALNIVYDKTEFAKHKVDLFVTENKNESENLQSKKPENELLQRIAKIPLSNGEGLGVELYDLWHLLYAEENDEAIKRKLRKWNFAESEIEKLLLIDFTKQGFRNLSTKAVKKLLPELEKGLMYNVACENVGYNHSNSLTKEQNNSRELLDKLEILKKNSLRNPLVEKVVNQVIHLINEIIDTYGKPDEIVIELARELKQNAKQRANTLDNNKTREKERKKNEEEIKILFPKLKKVPNKLLLRYELAKQQNWISPYTNLPIEPSAILYENGLYDIDHILPQSRFFDDSPVNLVLVESAEKKAKNNQTAYDYMQSKSKVLFEKFVEHIKATKYPKNKAERLQMTEKEIPEDFINRQLQDTRYIVKELKGILGKVCRTVRSTSGGVTDYLRHEWGISTLLRDMREETYPDTKAKRELAEQDGTVEKPKTRDDHRHHIIDAAVIALTSQAHIQRLNNLNQAFAHYQEMKEKARKMPCPVRNLHEIVKDELENTLVSYKGEGKVVVSKINKVTGQKTLTPRGELHNSSLYGAIKVRKYKEVAFNINFLEKVAKNEVQIANKKLRKFILEQLHNYNYDNKKLVKANLRFDNKLLEKVEIFVGYELRNTKKYDFDKNFGLKAAEFIVDKALKRHVIERLKTVGYDNEKGANPLKAFLEPIILQNGMIVKNVKCFVSKKEADYKPYKYNENGEPISYVKNGENHHIAIYKDKNGKLHETVCTFWDAVNRKLYGLPVVIKEPQKARELVENANAKIAPPQPCEMSHHPKEREKGSRIAIDELPEAHREFVTPLQKGEMFVFRMTKDEIEMAITQKKYKLISKNLYRVQSISIEPQVNFQFRHHLEATVTHNIAENSFILIQSLTSFESKNPIKVKINCLGKIVKVGE

SEQ ID NO: 8094 - protein, 1086 aa, unidentified
  REGION 1..1086: note = Description of Unknown:uncultivated organism sequence
MKKMNIGLDIGISSVGWSIVGEDYNIIDAGVRLFDDVSDPKTGKLKNEKRRESRSLRRMIRRTRNRKDDLINFFIEKNIIKDPDDFYEKINKSFSNFDVSTMSELKEKMLKEKLNNSALVLVLFNYMHNRGYFYKENENDSKEKNSENVDKTKNKFVKTNEFPSIQLNNFYKKYGFYKGSELSRDFSNSEWKNEIIHLLKTQKKDENFINEYMELFTRFRKYSEGPGSEKSPSEYGLWKIDPKTNKVFKDGDNLWEKTIGKCTIYPELIRGMKSSPFAEVFNILNDINNIHFDKKREKLTKEEKIKLFNKFSLDLEGKKISSITSKSIAKTLDLNLEDISGWVDEKKVSLKNYILIAKWLIQNKIYNGEKNLLNIDLLNQCNDIFNDLTKIKDVKEQAEKLSKDFPRASKDSTDELLKKISGLSATHSLSYKAMLEYINIGIKESINQMEVFSDKILENRKSKNNFLGKYIPRNLFEEEIISPTTRRSFNQSVAVINKIIKYYGDKYEIGYITIELARDKNSAEQRKNISKMQKRNKESLENVLKRENIDYDSLSNIQKIKIKLWEEQDRTDIYDGQEITIEDVKNNKNLDIDHIIPYSISMDNSLSNKVLSKSKNNKEKTNLSPYNWLSSQGKYEDFKQRVESIYVDKKKYKKKIQNLLFEGDPITDISDFIGRNLVDTRYASKLLLETLKLFFQNSKTIINVINGSVTNYCRYKVFELPKDREEYEHHAYDALIVSFLGMNHSISKIARLENMYNYKKKDNFQIVLNETGEVINLKNQFEIDNNSIHFKEELDNIKDKIKFSRMVLKNKNIPLSNETIRGFRKVGDENKIIQKIDIVNSSPKELNAYFNKEKLDDKKLEDLLIYLKDKYIYDCLFEIYNKYYQDDKKNPFISYMEDNFANESPFTKIRIGNQHIKNLKKYGDAKTFDNVILLKNHNDNAFLETLTIKSLRIYKNNKDKYVLIAINAKVLKSIKNNLVIDKEELNIKLSEKSIIDKKFIEIKKGTIIIDKNNNQIFYSNGGGNIGINQLEFKPINCSMSSFFSKTNSSKKIKRLFLSLSTLVENYFLADIDVLGNIYNKRKIEIN

SEQ ID NO: 8095 - protein, 1095 aa, unidentified
  REGION 1..1095: note = Description of Unknown:uncultivated organism sequence
MKPKINLGFDIGVASVGWAILDENNNILRMGSRLFDDAANNKDGSYASAERRGFRSNRRRLLREKNRKKDLINLFIDQGWINNFDEFQNLLNSYYKGREQEHILNLKVRCLNGEKVNNFEIMRILYHYIQHRGYFYKNIEDESENIVNNSTDLPSIQLLKLEKEIGFYKDTKESQSFSHQDWLKEVNKILENINLNETEFSKKYLDIFNRVRNFADGPGNEKTPTPYGRFYERNENGEFPLTLWEKTIGKCSIYPNEYRGGKSSPISELFNLLNDLNNLKIENSDNPELDKLSSNDKIELLQIMFNEVVNKNKSKNVNNKLIGKTFGFDEKFIKGYRIDKNQKPLYTELKSYNAIVKFIKENNLVNNLEFLNYTDESLLDLANDIYEICRKYYTDFNTLKDKVSNNYKIINPESFDLFKKLKFSDSHSLSYKAMKEYIFKVGINENINQSAYFYTKELANIEKQNRFGNSKYIPTNLFENEIISPTAKRALLQNIKVLNKIIKLYSKEYDIQNITIEMARDKNTAEERKRITEAQRNNEQQLNKICDLYNIDKDNLNSKTITKLKLWFQQESLDIYDGQKIDIDDLLKDSGAYEIDHIIPFSISGEDSLSNKVLTKKINNQNKGNKTPWQYLNSIGKFDSYHKRIEDLYSRNLINTKKFENLISSKDIRLDDVINFIGKNLSDTRYATRLVLNILQDFFDKKKDIYPYVKIKTIAGGMTNYARKNLFHIKKDRENFEHHAVDAAIIAFLGQDFVINKTLSSYYKYSKHQEVDVELDLSKFGAKNKDKDIQVFADELRHRIENKEISFSRPINTKNNISFADQTIYSISYNDDGTINTYKKLKLLRASNVDLEKYFGEKADQKDLNKLEVYSSNKNLYDELRKIYLHYSKLDSKANPFISYMKEINSNLSNNSIEPKYIQVGSYKVKKLKILDASNKNPLEVKILNYQDKKAALSSLDWTEIRIYKNNSGKFVLVTMNINFFKSTKNKEINKLEIDIPKLNDYLKEQKIENNERFIKLQRGSILRNINDNNLFYISGCTFANKRIEIKSLDTTNELKGLRKQNQIGISTIIENYSLLELDELGNIYSEIKLSDIIK

SEQ ID NO: 8096 - protein, 563 aa, unidentified
  REGION 1..563: note = Description of Unknown:uncultivated organism sequence
MEKRIFGFDIGIASLGWAVVDFDDTADPENNIYPTGKIVKSGVRCFPVAENPKDGKSLAFPRRQKRLQRKLCRRKARRMAGIKALFVANGLIDRASLFDEKENIYKARDKADVWDLRVKALTEKLTTVEFIRVLTHLAKHRGFKSYRIVQEKADKENGKVLAAVKANRALLENSKTLAQIIVEKGGPKRNRDDREGNSTYENSIPRDEIEREAKLIFEKQRELGLTAATEKLQRDFVGIAFRFREINGKKIEKMIGKCLFEKDEPRAPKNAPSAEFFVAWTKINNCHVRDNDGKLRFLTQEEKDAVFELLKNKKEVKYADIHKKLFPNRPDIRFADVEYNPKPVFDKKTGEIKEPSEPESLKFFALKGWHDLKSAIDVSAYPNEWLDKAVTVIATQKNDANISKELKNLGFSASDAENLAGLSFSKFISLSLKALYKILPEMQAGKKYNEACEAVGYDFKSTGESFAVQKGKFLPPIPESLATTVPVVNRAMAQFRKVYNVPWRANTARPTKSMSNWRATFITTMTNAGKLPQSKTNMQKKRKRSKHRRAANWSWPISADATC

SEQ ID NO: 8097 - protein, 1065 aa, unidentified
  REGION 1..1065: note = Description of Unknown:uncultivated organism sequence
MEKRIFGFDIGIASLGWAVVDFDDTADPENNIYPTGKIVKSGVRCFPVAENPKDGKSLAFPRRQKRLQRKLCRRKARRMAGIKALFVANGLIDRASLFDEKENIYKARDKADVWDLRVKALTEKLTTVEFIRVLTHLAKHRGFKSYRIVQEKADKENGKVLAAVKANRALLENSKTLAQIIVEKGGPKRNRDDREGNSTYENSIPRDEIEREAKLIFEKQRELGLTAATEKLQRDFVGIAFRFREINGKKIEKMIGKCLFEKDEPRAPKNAPSAEFFVAWTKINNCHVRDNDGKLRFLTQEEKDAVFELLKNKKEVKYADIHKKLFPNRPDIRFADVEYNPKPVFDKKTGEIKEPSEPESLKFFALKGWHDLKSAIDVSAYPNEWLDKAVTVIATQKNDANISKELKNLGFSASDAENLAGLSFSKFISLSLKALYKILPEMQAGKKYNEACEAVGYDFKSTGESFAVQKGKFLPPIPESLATTVPVVNRAMAQFRKVYNALVREYGTPDQINVELARDVYNNHDERREIAAKQNEYAEEKKKVKASACSKLELADISGRDLLKFRLYEQQDGKCIYSGEKLDLRRLVEQDYCDVDHIIPYSRSLDNSQNNKVLCLSRENRQKSDKTPLEYITDPVKQAEFIARVKSMKGLGSKKRDRLLIRDFNEKDVDFRERNINDTRYMARYIMKYLDDCIDFSQSKTDVKDRVQARNGALTDFLRHQWGLKKDRSESDKHHAQDAIVIACATNGYTQYLAHLSKIFENKQAYANKYGEPWYKAFKQHVKQPWDGFYQDVQASLAEIFVSRPPRKNATGEIHQDTVHTLNPKKKNRWGELVYSAKDVKSGLNVRGGMAGNSNMFRCDVFEKGGRFFIVPVYLADFCEKNRSDCFCPKDKEHEKPDETYKFLFSVFKDDYLSIETNKGEKFYGYMNQYITSTGQFYIGSNDSSPMYSISTSSFEKQDILLYRIGEKFEKCSVVDFDSEKQEMKVASLEDGSIHKIKASAKVNKKGETQKIYKTDKPYEKLDKGKTISSATFKRIRKYQVDPLGRYVEVKSEIRLPLNIKKGKS

SEQ ID NO: 8098 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFEPEQPRAPKEAPSAELFVALSKINNLKVTVDGERRFLNEEERKALLELLKNTKEVKYSTIKNKLFKGREVFFDDVNYAQKTKKGKSGEEKAVNPEDAKFYAMKGWHKLKAAFSPEQWKKVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSKTPYEYLEPLGRWEEFETVVNTTPSINRYKRNNLLNKDYKEKENDLEFRERNANDNSYIARYVKRYLEDAIDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMMKKNRHKKGE

SEQ ID NO: 8099 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREVGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTMVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRDASDRHHAQDAVVVACATQGMVQKLSKLSAIFENKDDFRRKKAEELGHEKAEVWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8100 - protein, 1010 aa, unidentified
  REGION 1..1010: note = Description of Unknown:uncultivated organism sequence
MKKRVFGFDVGISSLGWAVIDMDDDKDPEKQEEITGEIIAAGVRIFPGAENRKDGKSLAMPRRQKRLARRVCRRKALRKKDLKKLFVEKGLVGETDFVRKNVPLADVWDLRVQGLSRRLSGEELARVLLHLAKHRGFKSYRKAQEKEEEGGKVLEALSKNKALLSENENKTLAQIFVERGGKKRNFCRTVTKNGTEKTEACFDNLFTREEIIREAGLIFDRQRTFGSEFASPEFEEAFGEIAFRHREVDVQGVEKMLGVCPFEKDEKRAPKEAPSAEFFVALGKINSMSVLEGGRKRPLTEGERAALFDLLKARKKVTYRDIRQKVFNSPSEDDFRFSDVEYNPRPKYDKKTKELIVNKKAPEEKEFYSLKGYHALKGLIGEAYDIPTQDKIVSVIAIQKNDKNIEGQLKELGIHPDDIETLKGVSFSKFIGLSLKAVYRLLPEMEAGKKYNEACKAVGYDFKSTGEPFSREKGPFLPPIPQKLLTRVPVVNRAVSQFRKVYNAMVRTYGTPDQINVEMGRDIYNNAQDRKKIQKAQEEFRELKDAARQKAEERLGYGNVSLKVLLKFRLYEEQDGKSVYSGRSIDLDRLAKEPDYCDVDHIIPYSRSLDDSLNNKVLCFSSENREKSNRTPLEYLPAESRADFIGRVMSMKGIKSAKRDRLLIENFSAKEAEFRERNINDTRYMAKYLIKYLDDCIDFSGSSAILKDRVQSRSGGLTDFLRYQWGLKKDRSENDLHHAQDAIVIACATNGYTKYLAHLSKIFENKQRYAEKYGEAWYKAFKRHLKAPWDGFYEDVQKALAKIFVSRSPRKNATGELHKETICTLKPSHREFKEENVKSGFKVRGGIAGNGEMLRVDVFSKKNKRGKEQYYLVPVYLKDMAAKVLPNKAVVVGKPEEEWLEMDESYTFKFSLFPDDLCFVQKGEKKILGYYNGTDRSTAAISLEGHDRSFMKRGIGVKTLDTIRKFQVDPLGRCVEVKSEKRLPLKPKSAEQRRQDRWKNDFYKKHPETK

SEQ ID NO: 8101 - protein, 1012 aa, unidentified
  REGION 1..1012: note = Description of Unknown:uncultivated organism sequence
MRKRIFGFDLGIASIGWAVVDFDKEYFDHETGEVIEGNIVKSGVRCFPVAENPKDGSSLAEPRRLKRLARRICRRKARRMQGIKKLFIAKGLVSNETELADLYKTQRGGDVWNLRIKALSECLSAEKLIRVLTHLAKHRGFKSYRKAEEEKDEASGKVLKAIQENLSLLTDNKTLAQVVVEKAGADGKKRNYTVNVKNKKDKKEAVYINSIPRVEIERELKLIFEAQKQYGIFTQDLYDDFCKIAFRYRPAGSVADMVGFCTFEKGERRAPKESPSAELFVALTKINNMSIVDENGNIRKVNQQEREKIIALLKSTKTVKYTTLASKVFAKGVTFRDINYNATQKKTKDGQLKIVNPEDVVFYEMKGWHKLKSQFTDGEWVKFENDTELLDQVVNIIACEKNDENITNKLKAMGLDEESIAKFNNCSFSKFINLSFKALYKIIPHMQEDKENLYNDACKKAGYDYRLSTDKLVDSKGLLLAAIPQDKLTTVPVVNRTVSQFRKVYNALVRQYGLPDQINIEAGRDLKKTFEERKNIKSKNEENMQERKIAAEELSENTIKDTSTNILKYRLYKEQDGKCIYSGRVIDVNRLDEIGYLDVDHIIPYSRSLDNSYTNKVLCLSSENRKKGNKTPFEYIIDKNAWDEFEARVKLLHNKRKEDNLLNMTFADRELEFRERNANDNSHIARYVKQYCEDGIDFSSSPWKSIKNRVQVRTGYLTDYLRSQWGLVKNRDENDRHHAQDAIVIACATQEMVSYLSYVSSIFENKYEVQARTGEAWYKSLKDKWREPWIGFRNSVLSSLDEIFVSRPPRKNATGEIHQERIRTINPQFKKKYDAKEIKSGLAVRGGMAANGNMLRTDVFVKKNKKGKDEFYLVPVYLSDMGKELPNKAIVANKDEKEWVKIDESYIFKFSMFMDDLIKVTKGDKVIFGYFSGTHRGNGSITLEDHDRSKITAGIGVKTQDKIQKFAVDPLGKITEIKHETRLPLTNIKSNKQRIADRKVRREKTEQTKEQG

SEQ ID NO: 8102 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8103 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREVGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAIDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMMKKNRHKKGE

SEQ ID NO: 8104 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNENDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8105 - protein, 1068 aa, unidentified
  REGION 1..1068: note = Description of Unknown:uncultivated organism sequence
MKKKIFGFDLGIASIGWAIIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGNAIDLRRLDENGYCDVDHIIPYSRSLDDGQNNKVLCLAEENRKKGSKTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRDASDRHHAQDAVVVACATQGMVQKLSKLSAIFENKDDFRRKKAEELGHEKAEAWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8106 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8107 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8108 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLAASTAELETLYAAQTGGDVWNLRAEALRRPLSKEELLRVLTHLAKHRGFKSYRKAAEEADKESGRILTAIAENRKETAGFQTLAQMIVERAKHSDDHKMRNYTSQEGENKGVAVYVNSIPREEIEKETKLIFEYQKQFGLFTEDLYRDFCKIASRYREAGSVGHMVGRCRFEPEQPRAPKEAPSAELFVALSKINNLKVTVDGERRFLNGEERKALLELLKNTKEVKYLTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENEAERKEAEDWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAIDFSASSCTIGNRVQVRTGSLTDYLRHQWGLIKDRDASDRHHAQDAVVVACATQGMVQKLSKLSAIFENKDDFRRKKAEELGHEEAEAWYKYVKQQIREPWSGFRAEVLASLENVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWIELDETYQFKFSFYMDDLIKIKKKENEIFGYFRGTNRATASVSVTTHDRSHTFEGIGVKTQDGIEKYQVDPLGRIAKVKKETRLPLTMMKKNRHKKGE

SEQ ID NO: 8109 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGNVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGWFTEDLYCDFCKIAFRYREAGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNENDRHHAQDAVVVACATQGMVQKLSKLSAIFENKDDFRRKKAEKLGHEEAEVWYKYIKQQIREPWSGFRTEVLASLEKVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWLELDETYQFKFSFYMDDLIKIKKKENEIFGYFRGTNRATASVSVATHDRSHTFEGIGVKTLDGIEKYQVDPLGRIAKVKKETRLPLTMIKKNRHKKGE

SEQ ID NO: 8110 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8111 - protein, 837 aa, unidentified
  REGION 1..837: note = Description of Unknown:uncultivated organism sequence
MFTEDLYRDFCKIAFRYREVGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTMVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRDASDRHHAQDAVVVACATQGMVQKLSKLSAIFENKDDFRRKKAEELGHEKAEVWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8112 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREVGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENEAERKEAEDGLEKEGLAANSKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8113 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLAASTAELETLYAAQTGGDVWNLRAEALRRPLSKEELLRVLTHLAKHRGFKSYRKAAEEADKESGRILTAIAENRKETAGFQTLAQMIVERAKHSDDHKMRNYTSQEGENKGVAVYVNSIPREEIEKETKLIFEYQKQFGLFTEDLYRDFCKIASRYREAGSVGHMVGRCRFEPEQPRAPKEAPSAELFVALSKINNLKVTVDGERRFLNGEERKALLELLKNTKEVKYLTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIADDKLTTVPVVNRAVAQFRKVYNAMVRTYGAPDQINLEIGRDLKKSRDERNQIMRRQKENEAERKEAEDWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAIDFSASSCAIGNLVQVRTGSLTDYLRHQWGLIKDRDASDRHHAQDAVVVACATQGMVQKLSKLSAIFENKDDFRRKKAEELGHEEAEAWYKYVKQQIREPWSGFRAEVLASLEKVFVSRPPRKNATGEIHQETIRTVNPKRKKYNEKEILSGIKIRGGLAKNGLMLRTDVFVKKNKKGKDEFYLVPVYLSDMGKELPNKAMVPGKKENEWIELDETCQFKFSFYMDDLIKIKKKENEIFGYFRGTNRATASVSVTTHDRSHTFEGIGVKTQDGIEKYQVDPLGRIAKVKKEIRLPLTMMKKNRHKKEE

SEQ ID NO: 8114 - protein, 564 aa, unidentified
  REGION 1..564: note = Description of Unknown:uncultivated organism sequence
MKTKSLWFATAAAVVLTGMTMMTSCSKDDYELPEVIESEVYDEGEAGEVRAEVGTDGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8115 - protein, 1006 aa, unidentified
  REGION 1..1006: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGD

SEQ ID NO: 8116 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREVGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8117 - protein, 1068 aa, unidentified
  REGION 1..1068: note = Description of Unknown:uncultivated organism sequence
MKKKIFGFDFGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8118 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREVGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSKTPYEYLEPLGRWEEFETVVNTTPSINRYKRNNLLNKDYKEKENDLEFRERNANDNSYIARYVKRYLEDAIDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMMKKNRHKKGE

SEQ ID NO: 8119 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARSMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8120 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGNVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGWFTEDLYCDFCKIAFRYREAGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGISEDYREVFKKLTGSEFINLSLKALYKLNPYLAEGLKYNQACEKVGYDFREDGIKLAEKKGLLLPPIANDKLTTVPVVNRAVAQFRKVYNAMVRTYGAPDQINLEIGRDLKKSRDERNQIMRRQKENETERKEAADWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIRNRVQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8121 - protein, 1010 aa, unidentified
  REGION 1..1010: note = Description of Unknown:uncultivated organism sequence
MKKKIFGFDLGIASIGWAVVEFDSEYFNPETGEIIEGKIIKSGVRCFPVAENPKDGSSLAAPRREKRLARRICRRKARRMESVKKLFVAKGLVNNLTELDVIYASQVGGDVWNLRIKALSEPLSKEELIRVLTHLAKHRGFKSYRKAAEESDAEGGKVLKAIKENKLLLTDGKTLAQIITEQAGLNGKKRNCTKKDDKGKDIAIYNNSIPRDEIEREITLIYEAQNSYGIFSEDLYQDFKKIAFRYRPVGSVADMVGACTFEKGEKRAPKEAPSSELFVAMSKINNLAIEINGEKRFLSAEERRKLLELLKTTQKVKYTTIAKKIFNGCEVSFANIDYSKTTKKTKTNEIKEVNPEDVTFYEMKGWHKLKTRFSDEKWAEFMADMPLLDKIMNVIACEKNDENISKGLKELGVANEDISQFVEITTDKFINLSFKALYQINPYLEQGLKYNEACAKVGYDFKNTGEKLVSEDKKGVLLAVAEVPTLVPVVNRTVSQFRKVYNAMVRQFGAPDQINIETGRELKKTFEERKKIINKNKENEESREQSKTKLKNWNIKDNSTNILKYRLYDEQCGKCIYSGARIDINRFDEEGYLDVDHILPYSRSLDNSYNNKVLCLSSENRKKGNKTPFEYFKNTNSEEWDNFVGRVQTINNRKKKDNLLNTSFSDTENEVAFRERNANDNSYISRYVKQYLEEGIDFSQSARQDIKNRIQMRPGSLTDYLRHCWGLKKDRDKDDRHHAQDAIVIACTTQGMVKYLSTVSGLWENKWEIAKSQENEKAWYKSLKYKFKEPWSGFREDVEKSLYGDNEDDKGVFVSRPPRKSATGEIHQETIRSLNQKHKNFSEKDVKSGIRIRGGLANNGSMLRTDVFVKKNKKGKDEFYLVPIYLSDMGKELPSKAIVPLKFEDEWLQLDNSYTFKFSLYMDDLVKVKKGEKKIFGYFKGTGRTTGSITIEEPDRSSITPSIGVKTQDSIQKYAVDPLGNITEIKHETRMPLTHIKSNAQRHQERQAKK

SEQ ID NO: 8122 - protein, 1002 aa, unidentified
  REGION 1..1002: note = Description of Unknown:uncultivated organism sequence
MKKKIFGFDLGIASIGWAVIEFDNEYFNPETGEIIDGKIIKSGVRCFPVAENPKDGSSLAAPRREKRLARRICRRKARRMESIKKLFIAKNLVSDLKELDALYAEQQGGDVWNLRVKGLFEELSKEELLRVLTHLAKHRGFKSYRKAAEENDAEGGKVLKAINENKKLLTANQTLAQVIVERAGEGGKKRNYTETDAKGMAKAVYNNSIPRNEIERELDLIYEKQKQYGIFSKDLFDDFKKIAFRYRPLGSVADMVGYCTFEKGEKRAPKEAPSSEFFVAWGKINNMAVYENSQKRFLHPEEKVALFELLKTTQKVKYQAISKKIFAGKDIQFADVNYKLTEKKAKDGSVKEINPEDVLFYEMKGWHKLKALFDKEEWLDVSRDISLLDEAVNVVACEKNDENITKGLELIGISEKYIGKFVSLTTDKFVNLSLKALSKIIPYMEQGMKYNEACEKAGYDFKENVDRLVDKKGILLGVISADKQTKIPVVNRTVAQFRKVYNAMVRQFGVPDQINIETGRELKKSFDERRKIINKNKENEQERREAREELEQENIKGSSKNILKYRLYQEQDGKCIYSGKPIDLHRLDEEGYLDVDHIIPYSRSLDDSLNNKVLCLSSENRMKGNKTPFEYIRDKDSWEAFEARVNLLRNNRKKENLLSKNFNDRELEFRERNANDNNYIARYIKQYLEDGIDFNSCNRQDIKNRVQMRTGSLTSYLRHCWGLRKDRNENDRHHAQDAIVIACATQGMVQYLSTVSKLWENKWQLAQSKEDGEAWYKSLKYKFSEPWNGFREDVQKSLDEIFVSRPPRKSATGSVHKDTIDKCSENISRLSVRGGEAIKENMFRCDVYKTNTGYKIVPIYVVDLVNKEFKHYIQPYEEIDGNKIEAQEADFFCSLYKDDYIEIYVDKDEKYGGYFNQYNAQSGQIYLGSVDNASVYKIRDKKETNGYHLANEKKISLSKCVKLQKYIISPLGDKVLVQKETQRFSNITKSNAQRHKERQQKG

SEQ ID NO: 8123 - protein, 1068 aa, unidentified
  REGION 1..1068: note = Description of Unknown:uncultivated organism sequence
MKKKIFGFDLGIASIGWAIIDHSDENFDPETGEIIEGKVVGCGVRCFPVAENPKDGSSLAAPRRGKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFIEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGISEDYREVFKKLTGSEFINLSLKALYKLNPYLAEGLKYNQACEKAGYDFREDGIKLAEKKGLLLPPIANDKLTTVPVVNRAVAQFRKVYNAMVRTYGAPDQINLEIGRDLKKSRDERNQIMRRQKENEAERKEAADWLEKEGLAANGKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYVKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8124 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTTQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRYQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWLELDETYQFKFSFYMDDLIKIKKKENEIFGYFRGTNRATASVSVATHDRSHTFEGIGVKTLDGIEKYQVDPLGRIAKVKKETRLPLTMIKKNRHKKGE

SEQ ID NO: 8125 - protein, 1048 aa, unidentified
  REGION 1..1048: note = Description of Unknown:uncultivated organism sequence
MEKRIFGFDIGIASLGWAVVDFDDAADPENNIYPTGKIVKSGVRCFPVAENPKDGSSLAQPRRQKRLLRRLCRRKARRMAGIKNLFVTNGLVGKDALFNEKSNIYKARENADVWNLRVKALTEKLTTIEFIRVLTHLAKHRGFKSYRIALEKEDAESGKVLEAVKANRALLENGKTLAQIIVEKGGQKRNRKDKKGDATYANSIPRDEIERETRLIFERQRAFGLAAANEKLQRDFERIAFRFRPIAGVDKMIGKCQFEPDEPRAPKNAPSAEFFVAWTKINNCRVKDEDGRSRFLTQEEKETVFNLLKDQKEIKYSALRKALFAKRPDIKFADVEYNPKPVYDKKTGEIKEPPAPENLKFFSLKGWNELKRVIDVSAYPVETLDKIATVIATQKNDADISGELKRLGLPDSDIERLQGLQFKEFIRLSLKALYKILPEMMSGKKYNEACDAVGYDFKSTGESFAAQKGKFLPPIPDALATTVPAVNRAVSQFRKVYNALVREYGTPDQINIELARDVYNDHDERKKIEARQKEYAEEKEKAKALAQSKTGIEDIGGRDLLKFRLYEQQDGKCVYSGEALDLRRLTEQDYCDVDHIIPYSRSLDNSQSNKVLCLSRENRQKSDKTPLEYISDPVKQAEFIARVKSMKGLNKAKKDRLLTRGFDEREVEFRDRNINDTRYMARYVMKYLDDCIDFSQSKAAIKDRVQSRNGALTDFLRHQWGLRKDRAENDRHHAQDAIVIACATNGYTQYLACLSKIFENKQAYANKYGEPWYKAFKQHVKQPWDGFYQDVQSSLAEVFVSRPPRKNATGAIHKDTLYSKADKKGSLPIRGGLAEKDNMFRCDIFEKSGKFFVVPVYLADFYEENRADCFSPNDREHEKPDETYQFKFSIFKDDFLSIETDKGEKFYGYMNQYGAQTGQFYIGSNDSSAMYSLSTSSFKERDIIIFPTNKGGIKCTVVGFNDESNKMQLVALNNDAIFEVDATAKINKKGEIQKIYKTGRTYEKLDNEKKISISVFKRIKKYQVDPLGRYVEVKSETRLPLNIKKGNP

SEQ ID NO: 8126 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAIVCEKNDVGIERFLSEKGISEDYREVFKKLTGSEFINLSLKALYKLNPYLAEGLKYNQACEKVGYDFREDGIKLAEKKGLLLPPIANDKLTTVPVVNRAVAQFRKVYNAMVRTYGAPDQINLEIGRDLKKSRDERNQIMRRQKENEAERKEAADWLEKEGLAANSKNMLKYRLYQQQNGKCIYSGKAIDLRRLDENGYCDVDHIIPYSRSLDDGQNNKVLCLAEENRKKGSKTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRDVSDRHHAQDAVVVACATQGMVQKLSKLSAIFENKDDFRRKKAEELGHEKAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8127 - protein, 1028 aa, unidentified
  REGION 1..1028: note = Description of Unknown:uncultivated organism sequence
MKKRLGLDIGISSIGYGVIEYDDENFDGKIIDAGVRIFTVAENPKDGSSLSKPRRDAKSTRKRLSRKSNRLYNIRKLLISNNFITQAQIEELWTQNKQLKDLWDLRKDALNRILSNDEFYRILMYIAKHRGFKSTRKSEEAQKEGALLKSIKENNEEFEKNNYQTIGEMFASKFTNGVPKRNKKEKYNNSISRELLEKEIDIIFEKQRQFGSKIATTEIQDKYKSIAFYQTPLQSMANMIGYCTFEQNEKRAPKCAYTSEIFTSAGTLVNLSLIDEEGNSRFLTGEEINDIIELAHKQSKVTFKQAKNLLNLDDEVKFNSLNYNKKDKDGNIINPEIKTTLIELKNYHKIKKSIEQNLGKTYFETIKYDQDLFDNIATTLTYEKTDENIVKRLKSLGIDNEIIKSVKDLSMSKTMHLSIKAIKKILPYMLQGMKYSHACEEAGYNHSIVLKNKIKSTQLPVLTKEELTTNPVVNRAISQTRKVVNALIRKHGSFDNIIIETARDLSKSFKERREIKQAQEEFQKEKEKARQRCIEHGLDPDRPKSNLLRFRLFEEQGGFCVYSGKEIDPRRLADPNYTDIDHIIPYSRSFDDSLNNKVLCLSEENRQKGNKLPYEYIDQSKWYEFTQRLKTYHLKTAKFNRLIKKSYSQEGFISRNLNDTRYISRFIKDYIKENLDFNNNLKVETRNGSLTAFLRTQWGLIKNRDESDKHHALDAIVLACSTQGMVQYLSTISAKIENYEFINGKKPRFKKPWETFNEDLEIALSNIFVSRTVNAKVSGQLHDETIRSAKHIDEGFTTLKTPLEKINLNNLEKMYDKERNINLYNIIKTRLEQFNNDPKKAFEKPLYMKFSKEKEEKGQNAPQIKSIKIKDTSVAGIKIRNGLAWNAAIIRVDLFTKENKSGKKEYFFVPIYISDMGKELPNKAISKSKNGWIEMDANYNFCFSIYSNTLLSINMTGNPEDENFWYFRSIDRSDSRLTLDSHDRSIKEKRISPKNAFSIKKYQIDVLGEYHEVKREKRQHLKGAKYGI

SEQ ID NO: 8128 - protein, 1071 aa, unidentified
  REGION 1..1071: note = Description of Unknown:uncultivated organism sequence
MKKIIFGFDLGIASIGWAIIEYDDENFDPETGEIVEGKIIACGVRCFPVAENPKDGSSLAMPRREKRLLRRITRRKARRMLGIKRLFVAKGLAASTTELETLYAAQTGGDVWNLRAEALRRPLSKEELLRVLTHLAKHRGFKSYRKAAEEADKESGRILTAITENRKEAAGFQTLAQMIVERAKHSDDHKMRNYTPQEGENKGVAVYVNSIPREEIEKETKLIFEYQKQFGLFTEDLYRNFCKIAFRYREAGSVGHMVGRCRFEPEQPRAPKEAPSAELFVALSKINNLKVIVDGERRFLVESERQALLELLKNTKEVKYSTIKNKLFKGREVFFDDINYAQKSKKGKNGEEKPVNPEDTKFYAMKGWHKLKAEFGRQWEEVCSNLPLLDLGMTAVVCEKNDAAIDRFLIEKGMPEEYREVFKKLIGSEFINLSLKALYKINPYLAEGLKYNEACEKAGYDFRGDGTKLTEKKGLLLPPIAEDKLTTVPVVNRTVAQFRKVYNAMVRTYGAPDQVNLEVGRDLKKNHDERNQIMRRQKENEAERREAAEELEKEGLAASGKNMLKYRLYQQQNGKCIYSGKAIDLRRLDENGYCDIDHIIPYSRSLDDGQNNKALCLAEENRKKGNKTPYEYLEPLGRWGEFETIVNTTPSINRFKRNNLLNKTYKEKENDLEFRERNANDNSYIARYVKQYLEDAVDFSGSLCAIKNRIQVRTGSLTDYLRHQWGLVKDRNTSDKHHAQDAIVIACATQGMVQKLSKISAIFENKDIFRQKKAEELGHDEAEAWYNYIKKQIQQPWSGFRAEVLANLDKVFVSRPPRKNATGSAHKDTIYPKKAEKGSLPVRDGMAEKENMFRLDVFMKDEKYFIVPIYVVDLVNYKNFVDAPQPYGYSDGQLITIDEHFKFMFSLYKDDYVEIRSDDGVIKGYVNQYNAQSGQLYIGSADNSHIFKINTSTFVKGDRILLKKGDQFLVGKIGEYNKDTQQIEVMCGEEKYLIDAVVKLNKKGEETKNIQTGENYIKLANEKKINISVVNCLKKYQVDPLGRIAIVKKETRLPLVLIKKKRKQRKNGRKA

SEQ ID NO: 8129 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGWFTEDLYCDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNENDRHHAQDAVVVACATQGMVQKLSKLSAIFENKDDFRRKKAEKLGHEEAEVWYKYIKQQIREPWSGFRTEVLASLEKVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWLELDETYQFKFSFYMDDLIKIKKKENEIFGYFRGTNRATASVSVATHDRSHTFEGIGVKTLDGIEKYQVDPLGRIAKVKKETRLPLTMIKKNRHKKGE

SEQ ID NO: 8130 - protein, 685 aa, unidentified
  REGION 1..685: note = Description of Unknown:uncultivated organism sequence
MFAKGVTFRDINYNATQKKTKDGKLKIVNPEDVVFYEMKGWHKLKSQLTNGKWVKYKNNTELLHQIVNIIACEKNDENITNKLKAMGLDEESIAKFNNCSFSKFINLSFKALYKIIPHMQEDKENLYNDACKKAGYDYRLSTDKLVDSKGLLLAAIPQDKLTTVPVVNRTVSQFRKVYNALVRQYGLPDQINIEAGRDLKKTFEERKNIKSKNEENMQERKIAAEELIENTIKDTSTNILKYRLYKEQDGKCIYSGRVIDINRLDEIGYLDVDHIIPYSRSLDNSYTNKVLCLSSENRKKGNKTPFEYIIDKNAWDEFEARVKLLHNKRKEDNLLNMTFADRELEFRERNANDNSHIARYVKQYCEDGIDFSSSPWKSIKNRVQVRTGYLTDYLRSQWGLVKNRDENDRHHAQDAIVIACATQEMVSYLSYVSSIFENKYEVQARTGEAWYKSLKDKWREPWIGFRNSVLSSLDEIFVSRPPRKNATGEIHQERIRTINPQFKKKYDAKEIKSGLAVRGGMAANGNMLRTDVFVKKNKKGKDEFYLVPVYLSDMGKELPNKAIVANKDEKEWLKIDESYIFKFSMFMDDLIKVTKGDKVIFGYFSGTDRSTSSITLEAQDRSALYRSIGVKTQDEIQKFAVDPLGNITEIKHEIRLSLTNVKSNQQRIADRKARREKVEQAKAQE

SEQ ID NO: 8131 - protein, 1065 aa, unidentified
  REGION 1..1065: note = Description of Unknown:uncultivated organism sequence
MEKRIFGFDIGIASLGWAVVDFDDTAEPENNIYPTGKIVKSGVRCFPVAENPKDGSSLAFPRRQKRSQRKLCRRKARRMAGIKSLFVANGLIDRASLFNEKENIYKARDKADVWDLRVKALTEKLTTVEFIRVLTHLAKHRGFKSYRIASEKADKENGKVLEAVKANRVLLENGKTLAQIIVEKGGKKRNRDDREGKSTYENSIPRDEIERETKLIFEKQRELGLTAATEKLQRDFVEIAFRFRKINGKKIEKMIGKCLFEKDEPRSPKNAPSAEFFVAWTKINNCHVRDNDGKLRFLTQEEKDAAFELLKNKKEVKYADIRKKLFPNRPDIRFADVEYNPKPVFDKKTGEIKELPEPESLKFFALKGWHDLKSAIDVSAYPNERLDKAVTVIATQKNDADISKELKNLGFSASDVENLAGLSFSKFISLSLTALYKILPEMQAGKKYNEACEAVGYDFKSTGGSFAAQKGKFLPPIPESLATTVPVVNRAMAQFRKVYNALVREYGTPDQINVELARDVYNNHDERREIADRQNEYAEAKKKVKASACSKLELADISGRDLLKFLLYEQQDGKCVYSGEKLDLHRLVEQDYCDVDHIIPYSRSLDNSQNNKVLCLSRENRQKSDKTPLEYITDPVKQAEFIARVKAMKGLGSKKRDRLLLRDFNEKDVDFRERNINDTRYMARYIMKYLDDCIDFSQSKADVKDRVQARNGALTDFLRHQWGLKKNRSESDKHHAQDAIVIACATNGYTQYLAHLSKIFENKQAYANKYGEPWYKAFKQHVKQPWDGFYQDVQASLAEIFVSRPPRKNATGEIHQDTVHTLNPKKKNRRGELVYSAKDVKSGLNVRGGMAGNSNMFRCDVFEKGGRFFIVPVYLADFCEKNRSDCFCPKDKEHEKPDETYKFLFSVFKDDYLSIETNKGEKFYGYMNQYITSTGQFYIGSNDSSPMYSISTSSFEKQDILLYRIGEKFEKCSVVDFDSEKQEMKVASLEDGSIHKIKASAKVNKKGEVQKIYKTDKPYEKLDKGKTISSATFKRIRKYQVDPLGRYVEVKSEIRLPLNIKKGKA

SEQ ID NO: 8132 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAIVCEKNDVGIERFLSEKGISEDYREVFKKLTGSEFINLSLKALYKLNPYLAEGLKYNQACEKVGYDFREDGIKLAEKKGLLLPPIANDKLTTVPVVNRAVAQFRKVYNAMVRTYGAPDQINLEIGRDLKKSRDERNQIMRRQKENETERKEAADWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFTDAPQPYEYVDGSFIKIDESFNFMFSLYKDDYVEITSKDECIKGYVNQYNAQSGQLYISSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8133 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERDQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8134 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLAASTTELEALYAEQTGGDVWKLRAEALRSPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFEPEQPRAPKEAPSAELFVALSKINNLKVTVDGERRFLNEEERKALLELLKNTKEVKYSTIKNKLFKGREVFFDDVNYAQKTKKGKSGEEKAVNPEDAKFYAMKGWHKLKAAFSPEQWKKVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKNRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAIDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMMKKNRHKKGE

SEQ ID NO: 8135 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTTQKGPNKGVAVYVNSIPREEIEKETKLIFEYQKQFGLFTEDLYRDFCKIAFRYREAGSVGHMVGRCRFEPEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAIVCEKNDVGIERFLSEKGISEDYREVFKKLTGSEFINLSLKALYKLNPYLAEGLKYNQACEKVGYDFREDGIKLAEKKGLLLPPIANDKLTTVPVVNRAVAQFRKVYNAMVRTYGAPDQINLEIGRDLKKSRDERNQIMRRQKENETERKEAADWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8136 - protein, 1059 aa, unidentified
  REGION 1..1059: note = Description of Unknown:uncultivated organism sequence
MGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREVGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTMVPVVNRAVAQFRKVYNAMVRTYGAPDQINLEIGRDLKKSRDERNQIMRRQKENETERKEAEDGLEKEGLAANGKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8137 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTMVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRDASDRHHAQDAVVVACATQGMVQKLSKLSAIFENKDDFRRKKAEELGHEKAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8138 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRIPRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTTQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNWIQVRTGSLTDYLRHQWGLIKDRDASDRHHAQDAVVVACATQGMVQKLSKLSAIFENKDDFRRKKAEELGHEKAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVDGSFIKIDESFNFMFSLYKDDYVEITSQDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8139 - protein, 969 aa, unidentified
  REGION 1..969: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQE

SEQ ID NO: 8140 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREVGSVGHMVGRCRFESEQPRAPKEAPSAELFVVLSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTMVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRDASDRHHAQDAVVVACATQGMVQKLSKLSAIFENKDDFRRKKAEELGHEKAEVWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8141 - protein, 1005 aa, unidentified
  REGION 1..1005: note = Description of Unknown:uncultivated organism sequence
MKKKIFGFDLGIASIGWAVIDHSDENFDPETGEIIEGKGVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGWFTEDLYCDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNENDRHHAQDAVVVACATQGMVQKLSKLSAIFENKDDFRRKKAEKLGHEEAEVWYKYIKQQIREPWSGFRTEVLASLEKVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWLELDETYQFKFSFYMDDLIKIKKKENEIFGYFRGTNRATASVSVATHDRSHTFEGIGVKTLDGIEKYQVDPLGRIAKVKKETRLPLTMIKKNRHKKGE

SEQ ID NO: 8142 - protein, 1026 aa, unidentified
  REGION 1..1026: note = Description of Unknown:uncultivated organism sequence
MKYILGLDIGIASVGFAVVEQDDNREFTGISDAGVRVFRAAEQPKTGASLALPRREKRGSRRRLQRRVSRLYRLKQLFVQNGIITEQNIEELYIGGKKTIDVWNLRKDALERKLTGEEFYRCLMHIAKRRGFKSIRKSEEAKNSGALLKAIEENSVKFNQGKYRTIGEMYATLYADDIPKRNKRDSYKNSIPRNLLYDEVGIIFENQRKLGFDKATTELEDAYKNIAFYQRPLSSFEDKIGNCIFEKNEKRAPKYSYSAELFTAATRIVNTTIVDEMGNSRFFKESEILKLKDLAHINSKVTYAQAKKCLNLSQTDRFNSLNYNKKDKKTGELINPETSVFVELKGYHAIRKVIEKNLGKEYFNSIQYDKDLFNKIAFVLTCEKSDENIVKKMEELNIPNEIIRCVQDLSMSKVIHLSIKAIEKILPFMLTGMKYNEACFEAGYNHSVLNASKNKCCLLPVLQPNEMTTNPVVNRAISQTRKVINTLIKKYGAFDTIIVEMARDLSKSVNERREIEKAQEEFQAQKELARKRCIENGIDPDVPKSNLLKFRLWEEQNGYCMYSGKYIPPSKLKEPNSVQIDHIIPFSKSFDDSLNNKVLCLTDENQRKGNKIPYEHIGESNWHEFVNRIKMYNLKTAKVNRLTRKSYPKEDEAFKSRNLNDTRYMAKFIKDYIKENLDFDNNLKVETRNGAITAFLRTNWGLVKNRQKNDKHHAQDAVIIACTTQKMVQKISATAAQIEKNEYVNNKKPKYKKPWETFNEDIEKTISNIFVSRAIRAKISGEIHEETIRSAKHLAEGYTTLKTPIKKINLSILENMFDKERNIKIYEILKERLLEFDNDPKKAFEIPIYMPLSEEKVKLGQRPHEIKSIKIKDNGISGIKVNNGFASNSSIARLDVFKKENKKGKNEYFFVPVYVSDFGNDLPNKIFPVTKTSGNIDETYEFCFSLYQDCLISVNMSGNKSDEKYWYYRGFDISTGTITVDSNDREIEKQRISVKKAALIKKYQVGILGDIHEIKKEKRQSIKRKK

SEQ ID NO: 8143 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTMVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRDASDRHHAQDAVVVACATQGMVQKLSKLSAIFENKDDFRRKKAEELGHEKAEVWYKYIKQQIREPWSGFRTEVLASLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8144 - protein, 1068 aa, unidentified
  REGION 1..1068: note = Description of Unknown:uncultivated organism sequence
MKKKIFGFDLGIASIGWAIIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFIEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGISEDYREVFKKLTGSEFINLSLKALYKLNPYLAEGLKYNQACEKAGYDFREDGIKLAEKKGLLLPPIANDKLTTVPVVNRAVAQFRKVYNAMVRTYGAPDQINLEIGRDLKKSRDERNQIMRRQKENEAERKEAADWLEKEGLAANGKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYVKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8145 - protein, 962 aa, unidentified
  REGION 1..962: note = Description of Unknown:uncultivated organism sequence
MLLHVSAVCVIHEPLKLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8146 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKIRNYTPQKGPNKGVAVYVNSIPREEIEKETKLIFEYQKQFGLFTEDLYRDFCKIAFRYREAGSVGHMVGRCRFEPEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKKDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENKTERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8147 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTTQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYVKQQIREPWSGFRTEVLASLEKVFVSRPPRKNATGSAHKDTIFSKSEKKGSLPIRYGMAEKENMFRLDVFRKENHFYIVPIYVVDLVDCKEFTDAPQPYEYVDGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8148 - protein, 1068 aa, unidentified
  REGION 1..1068: note = Description of Unknown:uncultivated organism sequence
MKKKIFGFDLGIASIGWAIIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAIVCEKNDVGIERFLSEKGISEDYREVFKKLTGSEFINLSLKALYKLNPYLAEGLKYNQACEKVGYDFREDGIKLAEKKGLLLPPIANDKLTTVPVVNRAVAQFRKVYNAMVRTYGAPDQINLEIGRDLKKSRDERNQIMRRQKENETERKEAADWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8149 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGQVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGWFTEDLYCDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNENDRHHAQDAVVVACATQGMVQKLSKLSAIFENKDDFRRKKAEKLGHEEAEVWYKYIKQQIREPWSGFRTEVLASLEKVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWLELDETYQFKFSFYMDDLIKIKKKENEIFGYFRGTNRATASVSVATHDRSHTFEGSGVKTLDGIEKYQVDPLGRIAKVKKETRLPLTMIKKNRHKKGE

SEQ ID NO: 8150 - protein, 636 aa, unidentified
  REGION 1..636: note = Description of Unknown:uncultivated organism sequence
MKGWHKLKSLFEKDAWSEISKDISLLDRVVNVVVCEKNDENIIKGLKHINVPEKYIETFSSLTTDKFINLSLNALYKILPYMVQGMKYNEACEKAGYDFREKTDKLVEKKGVLLSVIPAEKQTKVPVVNRTISQFRKVYNAMVRQFGAPDQINIETGRELKKNYEERRKIINKNKENEQERKEAEEELRQENIKETSKNIWKYRLYQEQDGKCIYSGKSIDLRRLDEEGYLDVDHIIPYSRSLDDSFNNKVLCLSSENRMKGNKTPFEYIQNEDDWEAFEARVNLLRNNRKKENLLNKNFNDRELEFKERNANDNNYIAKYIKQYLEDGLDFSSSNRQDIKNRIQMRTGSLTSYLRHCWGLHKDRNENDRHHAQDAIVIACATQGMVKYLSTVSGLWENKWQVAQLKDNGEAWYKSLKYKFLEPWNGFREDVKQSLDEIFVSRPPRKSATGEIHQETIRSLNPKHKNYNKKDIKSGILVRGGLANNGSMLRTDVFVKKNKKGKDEFYLVPIYLSDMGKELPSKAIVPLKFEDEWLQIDDNFSFKFSLYMDDLVKVKKGEKEIFGYFKGTGRTTGSITIEAPDRSIITPSIGVKTQDAFKKYSVDPLGNYTEVKHESRIPLTLIKSNAQRYKEQQKG

SEQ ID NO: 8151 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAIDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVNCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8152 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAIVCEKNDVGIERFLSEKGISEDYREVFKKLTGSEFINLSLKALYKLNPYLAEGLKYNQACEKVGYDFREDGIKLAEKKGLLLPPIANDKLTTVPVVNRAVAQFRKVYNAMVRTYGAPDQINLEIGRDLKKSRDERNQIMRRQKENETERKEAADWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFTDAPQPYEYVDGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8153 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGQVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGWFTEDLYCDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNENDRHHAQDAVVVACATQGMVQKLSKLSAIFENKDDFRRKKAEKLGHEEAEVWYKYIKQQIREPWSGFRTEVLASLEKVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWLELDETYQFKFSFYMDDLIKIKKKENEIFGYFRGTNRATASVSVATHDRSHTFEGIGVKTLDGIEKYQVDPLGRIAKVKKETRLPLTMIKKNRHKKGE

SEQ ID NO: 8154 - protein, 1048 aa, unidentified
  REGION 1..1048: note = Description of Unknown:uncultivated organism sequence
MEKRIFGFDIGIASLGWAVVDFDDAADPENNIYPTGKIVKSGVRCFPVAENPKDGSSLAQPRRQKRLLRRLCRRKARRMAGIKNLFVTNGLIGKNALFDEKNNIYKARDNADVWDLRVRALTERLTTVDFIRVLTHLAKHRGFKSYRIALEKEDAESGKVLEAVKANRALLENGKTLAQIIVEKGGQKRNRKDKKGDATYANSIPRDEIERETRLIFERQRAFGLAAANEKLQRDFERIAFRFRPIAGVDKMIGKCQFEPDEPRAPKNAPSAEFFVAWTKINNCRVKDEDGRSRFLTQEEKETVFNLLKDQKEIKYSALRKALFAKRPDIKFADVEYNPKPVYDKKTGEIKEPPAPENLKFFSLKGWNELKRVIDVSAYPVETLDKIATVIATQKNDADISGELKQLGLPDSDIERLQGLQFKEFIRLSLKALYKILPEMMRGKKYNEACDAVGYDFKSTGESFAAQKGKFLPPIPESLATTVPTVNRAISQFRKVYNALAREYGTPDQINVELARDVYNDHDERKKIEARQKEYAEEKEKAKALAQSKTGIEDIGGRDLLKFRLYEQQDGKCVYSGEALDLRRLTEQDYCDVDHIIPYSRSLDNSQSNKVLCLSRENWQKSDKTPLEYISDPVKQAEFIARVKSMKGLNKAKKDRLLTRGFDEREVEFRDRNINDTRYMARYVMKYLDDCIDFSQSKAAIKDRVQSRNGALTDFLRHQWGLRKDRAENDRHHAQDAIVIACATNGYTQYLACLSKIFENKQAYANKYGEPWYNAFKQHVKQPWDDFYQDVQSSLAEVFVSRPPRKNATGAIHKDTLYSKADKKGSLPIRGGLAEKDNMFRCDIFEKSGKFFVVPVYLADFYEENRADCFSPNDREHEKPDETYQFKFSIFKDDFLSIETDKGEKFYGYMNQYGAQTGQFYIGSNDSSAMYSLSTSSFKERDIIIFPTNKGGIKCTVVGFNDESNKMQLVALNNDAIFEVDATAKINKKGEIQKIYKTGRTYEKLDNEKKISISVFKRIKKYQVDPLGRYVEVKSETRLPLNIKKGNP

SEQ ID NO: 8155 - protein, 1028 aa, unidentified
  REGION 1..1028: note = Description of Unknown:uncultivated organism sequence
MKKRLGLDIGISSIGYGVIEYDDENFDGKIIDAGVRIFTVAENPKDGSSLSKPRRNARSTRKRLSRKSNRLYNIRKLLISNNFITQAQIEELWTQNKKLKDLWDLRKDALNRMLSNDEFYRILMYIAKHRGFKSTRKSEEAQKEGALLKSIKENNEEFEKNNYQTIGEMFASKFTNGVPKRNKKEKYNNSTSRELLEKEIDIIFEKQRQFGSKIATTEIQDKYKSIAFYQTPIQSMANMIGYCTFEQNEKRAPKCAYTSEIFTSAGTLVNLSLIDEEGNSRFLTGEEINDIIELAHKQSKVTFKQAKNLLNLDDEVQFNSLNYNKKDKDGNIINPEIKTTLIELKNYHKIKKSIEQNLGKTYFETIKYDQDLFDNIATTLTYEKTDENIVKRLKSLGIDNEIIKSVKDLSMSKTMHLSIKAIKKILPYMLQGMKYSHACEEAGYNHSIVLKNKIKSTQLPVLTKEELTTNPVVNRAISQTRKVVNALIRKHGSFDNIIIETARDLSKSFKERREIKQAQEEFQKEKEKARQRCIEHGLDPDRPKSNLLRFRLFEEQGGFCVYSGKEIDPRRLADPNYTDIDHIIPYSRSFDDSLNNKVLCLSEENRQKGNKLPYEYIDQSKWYEFTQWLKTYHLKTAKFNRLIKKSYSQEGFISRNLNDTRYISRFIKDYIKENLDFNNNLKVETRNGSLTAFLRTQWGLIKNREENDKHHALDALVLACSTQGMVQYLSTISAKIENYEFINGKKPRFKKPWETFNEDLEIALSNIFVSRTVNAKVSGQLHDETIRSAKHIDEGFTTLKTPLEEINLNNLEKMYDKERNIDLYNIIKTRLEQFNNDPKKAFEKPLYMKFSKEKEEKGQKAPQIKSIKIKDTSVAGIKIRNGLAWNASIIRVDLFTKENRSGKKEYFFVPIYISDMGKELPNKAISKSKNGWIEMDANYNFCFSIYSNTLLSINMTGNPEDENFWYFRSIDRSDSRLTLDSHDRSIKEKRISPKNAFSIKKYQIDVLGEYHEVKREKRQHLKGAKYGI

SEQ ID NO: 8156 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETVGFQTLAQMIVERAKHSDDHKMRNYTPQKGPNKGVAVYVNSIPREEIEKETKLIFEYQKQFGLFTEDLYRDFCKIAFRYREAGSVGHMVGRCRFESEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYQQQNGKCIYSGNAIDLRRLDENGYCDVDHIIPYSRSLDDGQNNKVLCLAEENRKKGSQTPYEYLEPLGRWEEFETVVNTTPSINRYKRNNLLNKDYQEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8157 - protein, 1028 aa, unidentified
  REGION 1..1028: note = Description of Unknown:uncultivated organism sequence
MKKRLGLDIGISSIGYGVIEYDDENFDGKIIDAGVRIFTVAENPKDGSSLSKPRRDARSTRKRLSRKSNRLYNIRKLLISNNFITQAQIEELWTQNKQLKDLWDLRKDALNRILSNDEFYRILMYIAKHRGFKSTRKSEEAQKEGALLKSIKENNEEFEKNNYQTIGEMFASKFTNGVPKRNKKEKYNNSISRELLEKEIDIIFEKQRQFGSKIATTEIQDKYKSIAFYQTPLQSMANMIGYCTFDQNEKRAPKCAYTSEIFTSASTLVNLSLIDEEGNSRFLTGEEINNIIELAHKQSKVTFKQAKNLLNLDDKVKFNSLNYNKKDKDGNIINPEIKTTLIELKNYHKIKKSIEQDLGKTYFETIKYDQDLFDNIATTLTYEKTDENIVKRLKSLGIDNEIIKSVKDLSMSKTMHLSIKAIKKILPYMLRGMKYSHACEEAGYNHSIVLKNKIKSTQLPVLTKEELTTNPVVNRAISQTRKVVNALIRKHGSFDNIIIETARDLSKSFKERREIKQAQEEFQKEKEKARQRCIEHGLDPDKPKSNLLRFRLWDEQGGFCIYSGKPIKPERLADPNYTDIDHIIPYSRSFDDSLNNKVLCLSEENRQKGNKLPYEYIDQSKWYEFTQRLKTYHLKTAKFNRLIKKSYSQEGFISRNLNDTRYISRFIKDYIKENLDFNNNLKVETRNGSLTAFLRTQWGLIKNRDESDKHHSLDAIVLACSTQGMVQYLSTISAKIENYEFINGKKPRFKKPWETFNEDLEIALSNIFVSRTVNAKVSGQLHDETIRSAKHLDEGFTTLKTPLEKINLTTLDKMYDKERNIDLYNIIKTRLEQFNNDPKKAFEKPLYMKFSKEKEEKGQNAPQIKSIKIKDTSVAGIKIRNGLAWNAAIIRVDLFTKENRSGKKEYFFVPIYISDMGKELPNKAISKSKNGWIEMDANYNFCFSIYSNTLLSINMTGNPEDENFWYFRSIDRSDSRLTLDSHDRSIKEKRISPKNAFSIKKYQIDVLGEYHEVKREKRQHLKGAKYGI

SEQ ID NO: 8158 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKIRNYTPQKGPNKGVAVYVNSIPREEIEKETKLIFEYQKQFGLFTEDLYRDFCKIAFRYREAGSVGHMVGRCRFEPEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKKDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENKTERKEAEDGLEKEGLAANGKNMLKYRLYQQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIRNRVQVRTGSLTDYLRHQWGLIKDRDASDRHHAQDAVVVACATQGMVQKLSKLSAIFENKDDFRRKKAEELGHEKAEAWYKYVKQQIREPWSGFRTEVLAGLEKVFVSRPPRKNATGSAHKDTIFSKSEKKGSLPIRYGMAEKENMFRLDVFRKENHFYIVPIYVVDLVDCKEFIDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8159 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREAGSVGHMVGRCRFEPEQPRAPKEAPSAELFVALSKINNLKVTVDGERRFLNGEERKALLELLKNTKEVKYSTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGEIHQETIRTVNPKRKKYNEKEILSGIKIRGGLANNGLMLRTDVFVKKNKKGKDEFYLVPVYLSDMGKELPNKAMVPGKKENEWLELDETYQFKFSFYMDDLIKIKKKENEIFGYFRGTNRATASVSVATHDRSHTFEGIGVKTLDGIEKYQVDPLGRIAKVKKETRLPLTMIKKNRHKKGE

SEQ ID NO: 8160 - protein, 1005 aa, unidentified
  REGION 1..1005: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLAASTAELETLYAAQTGGDVWNLRAEALRRPLSKEELLRVLTHLAKHRGFKSYRKAAEEADKESGRILTAIAENRKETAGFQTLAQMIVERAKHSDDHKMRNYTSQEGENKGVAVYVNSIPREEIEKETKLIFEYQKQFGLFTEDLYRDFCKIASRYREAGSVGHMVGRCRFEPEQPRAPKEAPSAELFVALSKINNLKVTVDGERRFLNGEERKALLELLKNTKEVKYLTIKNKLFKGREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIADDKLTTVPVVNRAVAQFRKVYNAMVRTYGAPDQINLEIGRDLKKSRDERNQIMRRQKENEAERKEAEDWLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAIDFSASSCTIGNRVQVRTGSLTDYLRHQWGLIKDRDASDRHHAQDAVVVACATQGMVQKLSKLSAIFENKDDFRRKKAEELGHEEAEAWYKYVKQQIREPWSGFRAEVLASLEKVFVSRPPRKNATGEIHQETIRTVNPKRKKYNEKEILSGIKIRGGLAKNGLMLRTDVFVKKNKKGKDEFYLVPVYLSDMGKELPNKAMVPGKKENEWIELDETCQFKFSFYMDDLIKIKKKENEIFGYFRGTNRATASVSVTTHDRSHTFEGIGVKTQDGIEKYQVDPLGRIAKVKKEIRLPLTMMKKNRHKKEE

SEQ ID NO: 8161 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDYKEFIDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8162 - protein, 1068 aa, unidentified
  REGION 1..1068: note = Description of Unknown:uncultivated organism sequence
MKKKIFGFDLGIASIGWAVIDHSDENFDPETGEIIEGKVVGCGVRCFPVAENPKDGSSLAAPRREKRLLRRITRRKARRMLGIKRLFVAKGLVASTTELEALYAEQTGGDVWNLRAEALRRPLSKEELLRVLTHLAKHRGFKSYRKAAEEADKESGRILTAIAENRKETAGFQTLAQMIVERAKHSDDHKMRNYTPQKGPNKGVAVYVNSIPREEIEKETKLIFEYQKQFGLFTEDLYRDFCKIAFRYREVGSVGHMVGRCRFEPEQPRAPKEAPSAELFVALSKINNLKVTVDGERRFLNGEERKALLELLKNTKEVKYSTIKNKLFKSREVFFDDVNYAQKTKKGKSGEEKAVNPEDAKFYAMKGWHKLKAAFSPEQWKEVGSNLPLLDLGMTAVVCEKNDAGIERFLSEKGIPEDYREVFKKLTGSEFINLSLKALYKLNPYLAEGLKYNQACEKAGYDFREDGIKLAEEKGLLLPPIANDKLTTVPVVNRAVAQFRKVYNAMVRTYGAPDQINLEIGRDLKKSRDERNQIMRRQKENETERKEAEDGLEKEGLAANGKNMLKYRLYRQQNGKCIYSGKAIDLRRLDENGYCDVDHIIPYSRSLDDGQNNKVLCLAEENRKKGSQTPYEYLEPLGRWEEFETVVNTTPSINRYKRNNLLNKDYKEKENDLEFRERNANDNSYIARYVKRYLEDAVDFSASSCAIKNRIQVRTGSLTDYLRHQWGLIKDRNESDRHHAQDAVVVACATQGMVQKLSKLSAIFENKDDFRRKKAEKLGHEEAEVWYKYIKQQIREPWSGFRTEVLASLEKVFVSRPPRKNATGSAHKDTIFSKSEKKGSLPIRYGMAEKENMFRLDVFRKENHFYIVPIYVVDLVDCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 8163 - protein, 1001 aa, unidentified
  REGION 1..1001: note = Description of Unknown:uncultivated organism sequence
MKKKIFGFDLGIASIGWAVVEFDNEYFNPETGEIVEGRIIRSGVRCFPVAENPKDGTSLAVPRREKRLARRICRRKARRMDSIKGMFVAKNLISNVKELNSLYASQQGGDVWDLRVKGLFEKLSKEELLRVLTHLAKHRGFKSYRKAAEENDAEGGRVLKAINENKKLLTGDKTLAQVIVERAGECGKKRNYTVDVKGVKTAVYNNSIPRSEIERELDLIYEKQKQYGIFSEDLFNDFKKIAFRYRPIKSVADMVGCCTFERGEKRAPKEAPSSEFFVACGKINNLAVYENGQKRFLRLEEREALFELLKTTQKVKYQTISKKIFSGKDIQFVGINYTKTYKKSKDGSVKDVNPEDAVFFEMKGWHKLKSKFEKDEWLEISRNIPLLDKAVNVIACEKNDENIVRGLRDIGISEKYIESIASLTTDKFINLSLKALYKIIPHMERGMKYNEACERAGYDFRENADKLVEKSGTLLSVIPAEKQTKVPVVNRAVAQFRKVYNAMVRQFGVPDQINIETGRELKKNYEERKKIINKNKENEQERNDAREELRQENIRESSKNILKYRLYQEQDGKCIYSGKSIDLHRLDEEGYLDVDHIIPYSRSLDDSFNNKVLCLSSENRMKGNKTPFEYIQKESNWDVFEARVNLLRNNKKKENLLNRNFKDRELEFRERNANDNNYISRYIKQYLEDGIDFSFSSRQDIKNRIQMRTGSLTSYLRHCWGLSKNRDENDRHHAQDAIVIACATQGMVKYLSTVSALWENKWQVAQSKEDGEAWYKSLKHKFSEPWGSFREDVKKSLDDVFVSRPPRKSATGSVHKDTIDKKTNNISRLLVRGGEAAKENMFRCDVYRTSTGYKFVPIYVVDLVNKKFKHYFQPYEEIDGCKIEANENDFLFSLYKDDYIEIYLNGDEVYVGYFNQYNAQSGQIYLGAVDNASIYKIRDKKAIDGYHLDNEKKISLSKCVKLQKFVISPLGDKVLVKREKRRFSNTIKSNAQRYKERQQKG

SEQ ID NO: 8164 - protein, 755 aa, unidentified
  REGION 1..755: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADDYDNYITPDEKKLIINEYIIKKGKITIQKLCDVLQVKKENITGFRVNKGEPILTEFKGYQKVLKALNRIIDTEIVDAVIDVLTKYKDVEKRKEEIKKISNAEFSEEDIVKLSEITGIQQYHSLSYKAMKVIIPELYENSENQMEVITRLNLVKTSIDDLKGRTTIPSYSDRIYSPVAKRVHNETIKVINAVIKKYGDLDSIVIEMARDRNTAEERKNIEQAQKRNQENREKAKEILDVNHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLF

SEQ ID NO: 8165 - protein, 1056 aa, unidentified
  REGION 1..1056: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDVKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8166 - protein, 1078 aa, unidentified
  REGION 1..1078: note = Description of Unknown:uncultivated organism sequence
MNKYILGLDVGIASVGWAIVEKDTYSIIDSGVRLFQEGTAEDNAARRTKRGTRRLTRRRKQRLEDFIQLSKDFNIIVKPTFLSDPLSLRIKGLTEKLTNDEIFTALYHIIKYRGTSLETVSESDEEKGTKGILNANEKLLSKYQYVCLVQKYRLDSNMQYRGNENTFKTENYVQEAVKILSNQDVPEAYKQKVIDLIKRRRHFSEGPGSEKSPTPYGRYFINDKNEIEFIDLIEKMRGRCSVFNNELRAPKNAPSVELFNFLNDLNNMNVENKKITQNQKNLIINNFIINGKQGITVKQLAKFLEIDENEISGLREDASNKKLLTEFVGLKKLIKQLPLERKQLYLDNFNVLDKIANILTSTKIISEREEKIKNLDFEFMNPEEISLFANVPGISGYHSLSFKAIYLLNQEMMQTNENQIQILYRLGLYKNDLDRFVGYDNIPSNHELIINPVVQRSLNETIKIINSVRKKFGELDSIVIEMARDKNSKEVKKRISNEIKKRNETNKQILDDLKVDQVDRRILIKLLLYHQQEGKCLYTGTSLDRNLIMSDPYSYHIDHIIPISVSYDDSLNNKVLVLNKANTDKGNLTPIMAFNNHRFDGWDKETYISNVNSLHRNRLISNKKKDYLLYEKDITKYSNMGGFIQRNLVDTRYASRGVLNILQNYFKANDIPTKVFTIRGNITSVIRNKVGIVKDRDDNYLHHAIDAATIALLPSNNQINKLLRRLNYDSGEVVVENISDNPVITQQEFFEESFMKRFVPLKELAESHKIGDEPYSYFESEIKISHKVDRKPNRKLADDTIYSTRKVNDQELVVKKYQNIYDAQFLSLAKDIADKKYDKYLMYHHDPKTFEKLIEVVESYLKEFKKIKKINPFNEYFQQHGKITKYAKNNNGPEITAIKFYDGQLGSHVSLSSKQKSKKKNVVLLQIKPYRTDFYRNEEGIYKFITIRMHHVRYSKSRNTYYIDSELYNSLLEDKGVDNSFEFQFSMHRNEYLLMEQKILVSKNIHDINKEIYRYIATNNDDKNVVEVKPINYREQKRIMKTIGRNIIKLSKYHSDNLGNLYLSKNESLKLEFKIGIM

SEQ ID NO: 8167 - protein, 1078 aa, unidentified
  REGION 1..1078: note = Description of Unknown:uncultivated organism sequence
MEKLILGLDIGIASVGWAVVNNQQHTIIDSGVRLFQEGSAEENATRRSSRGTRRLIRRRKQRLEDFVQLCKTHNLIQEPTFLENPLDLRIKGLSNKLTNEELFTALYHIVKYRGTSLETVSESKEEEGTKGILNANERLLLEHKYVCKVQKFRLEKNLSYRGNENTFKTKHYVEETEMILMNQDISDIFKNEIVQLIKRRRHYSEGPGSEKSPTPYGRYFLNENNELVKIDLIEKMRGRCTVFSEELRAPKNAPSVELFNFLNDLNNMSFSNTKLTQNQKNLLINNFIINGKQNLTIKQLAKFLEVDEIDITGLREDANKKKLITEFKGLKKIIKPLSKERKRFYLDNFEILDKVANVLTSTKVISERKQKLKSLDIEYITEEEIEAFANVPGISGYHSLSFKAIYLINREMVRTNDNQIQVLYRLNLHQSNLDFYRDKINIPSDHELIINPVVRRSLNEAIKVVNSLRKKYGEFDSIIIEMARDKNTKEEKKRITKEIKKRNETNKQILDDLNVEDLNKRVLIKLLLYHQQQGKCLYTGTPLDRNLIISDPHSYHIDHIIPVSVSYDDSLNNKALVLYKANLDKDNLTPIMAFNNHRFDGWDKKTYVAFVNMLLKSKLITNKKKDYLLYEEDVTKYSNMGNFIARNLVDTRYASRGVLNILQDYFSANDIATKVFAVRGNITSVIRNKVGIVKDRDDNYIHHAIDAATIALLPSHTQINRLLNKLKYSGDAVEVEQSEENPVVSQREFFEESFMKRFVSLKNLAEEHKVADNPYSYLRSEIKISHKVDRKPNRKLADDTIYSTRNVNGQELVVKKYQDIYDAKFMNLAKDIYNKNYHKYLMYHHDPQTFDKLIEIVDDYLEDFKEIKTENPFNIYFKQHGKVKKYSKKNNGPDVTSLKYYDGQLISHVSLNAKQHSKNKNIVLLQIKSYRTDFYRNKEGFYKFVTIRMHHVQHSKSRNIYFIDKNVYSKLLEEKGVGNDFEFQFSMHRNEYLYIEQKIRISKNIYDVDKEIYRYVATNNDNKNVVEVKPINYRENKQVMKTIGKNILKLTKYHCDILGNIYESNNESLKLEFNIGKM

SEQ ID NO: 8168 - protein, 906 aa, unidentified
  REGION 1..906: note = Description of Unknown:uncultivated organism sequence
MRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDANHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNKYSEDIKISHKVDRKPNRKFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYSNLPNDKKVVLLQISPYRTDFYLTKEGNYKFLTIRYANIRENHNGYYIPKEVYESLKKSKKINDSDEFLFSLYQNDYLRITTNDPTENVPMIYRFVGTNNDLANKVEVKPIYCNKIDKPQIMKTIGKKVTKIEKFDVDVLGNKIAKKRDKCLQLEL

SEQ ID NO: 8169 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEEKIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8170 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHENGEVEVIHSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 8171 - protein, 665 aa, unidentified
  REGION 1..665: note = Description of Unknown:uncultivated organism sequence
MTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGDVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8172 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKSELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8173 - protein, 1067 aa, unidentified
  REGION 1..1067: note = Description of Unknown:uncultivated organism sequence
MAKYILGLDMGITSVGWGLIDYDSGKIVDKGVRLFKEATAKDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHENGEVEVIHSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTMHKDVEKRKEEIKKINNTEFSEEDIVKLSEITGIQQYHSLSYKAMKVIIPELYENPENQMEIITRLNLVKTSIDDLKGRTTIPSYSDRIYSPVAKRVHNETIKVINAVIKKYGDLDSIVIEMARDRNTAEEQKNIEQVKKRNQENREKAKEIIEVNHSFSKLDSKLVQKIMLYNQQDGKSMYSGKPINLNVLISDREAYEIDHIIPLSISLDDSIANKVLVYKSENQQKLNNTPLQYLRSGNSNGWSVDEFREVVIKMYNDKKISLKKLQNLLCEKDITKYDVRKGFIERNLVDTRYASRVVLGLLKDYFKANNKNTKVFTVRGQITSQFRRAKNLKKDRNYFYHHIVDALIIAHFRKFNYISELMQYGFNHKEKIDEETGELIQYNDTLFPKKDDDFTIQLRKLNDLNIYSENIKISHKVDRKPNRQFSDETIYSARKIDNDYMKISKYKDIYGEEGKKFAKKIKDNLQKENELDIFLMKKVDPETFNLLVSIVKNTICGEKENPFVKYCEENNIDFIRKKSKNGNGPIIRSIRYYDGKVNSYQDISQKYSNLSDDKKVVRLQISPYRTDFYLTKEGNYKFLTVKYANIKENHNGYYIPKEVYESLKKSKKINDSDEFLFSLYRNDYLRISTNDPAENAPMIYRFVETTDDLKNVVKVEPIYCEIYIRKTIGKKITKIEKFDVDVLGNKIAKKRDKCLQLEL

SEQ ID NO: 8174 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSFEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAIDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8175 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRQSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEKMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8176 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNIISNVNFDILDNVYELRVKGLTQKLTNLELANVLVNLAKRRGSSLDVAVDEDDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGPKIKFDSSAILSPVTKRVHMQAIQVVNELRKEYGEFDSIVIETTRAKNSSDEKKDIQEDQKKLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLCDTSYGVRTVMNTMHQYFNDNNINTNVFTVKGRLTNIFRSRVGLKKDRDYFIHHAVDALIIAGSKNQSVFNNAYLLSTTKDGILIKKTGEVFNYSQDPFDDPRFLNYISSLKQIEGKPEDFSYKVDKKTNRQFADQTIYSTRNYDGVDYVVKKYKDIYGKEGESLKKLFDDKKEQTLLMARNDIQTFELFKKIYENYKNEKNPFAKYKEEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKRIDETYEFKFSLNRNDIINLVTVDNQAYHINEMLYRFIGTNNDKTNKIEIRYIEKMTLKRIMVSIGKKIVKFEKYNVSPTGKKAKAEKEVLKLKWK

SEQ ID NO: 8177 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNEVNDKIVEIIMRRRNLSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8178 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKLDSSAILSPVTKRVHMQAIQVVNELRKEYVEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8179 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDANHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNKYSEDIKISHKVDRKPNRKFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYSNLPNDKKVVLLQISPYRTDFYLTKEGNYKFLTIRYANIRENHNGYYIPKEVYESLKKSKKINDSDEFLFSLYQNDYLRITTNDPTENVPMIYRFVGTNNDLANKVEVKPIYCNKIDKPQIMKTIGKKVTKIEKFDVDVLGNKIAKKRDKCLQLEL

SEQ ID NO: 8180 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDANHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCNKIDKPQIMKTIGKKVTKIEKFDVDVLGNKIAKKRDKCLQLEL

SEQ ID NO: 8181 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGPKIKFDSSAILSPVTKRVYMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVCPTGKKAKAEKEVLKLKWK

SEQ ID NO: 8182 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8183 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNIYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDKKRLEEQKRKSDELLIDLDKNPDNYNTLTKLKLRLYKEQEGKTIYAGLPIDLDLLLSDPTAYQIEHIIPYAVSFDNSMNNKSLASAKENQDKGKRTPWQYFSSGMVSECEGPINDWESFEAFVNSLKISKNKKNNLLNQEDVTKFDNMNAFVARNLIDTSYGVRTVMNTMQQYFNDNNINTNVFTVKGRLTNIFRSRVGLKKDRDYFIHHAVDALIIAGSKKQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIFQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8184 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGPKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDRDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTKVFTVKGRLTNIFRSRVGLKKDRDYFIHHAVDALIIAGSKNQSVFNNAYLLSTTKDGILIKKTGEVFDYSQDPFDDPRFLNYISSLKKIEGKPEYFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKRIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8185 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNIISNVNFDILDNVYELRVKGLTQKLTNLELANVLVNLAKRRGSSLDVAVDEDDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGPKIKFDSSAILSPVTKRVHMQAIQVVNELRKEYGEFDSIVIETTRAKNSSDEKKDIQEDQKKLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFANQTIYSTRNYDGVDYVVKKYKDIYGKDGESLKKLFDDKKEQTLLMARNDIQTFELFKKIYENYKNEKNPFAKYKDEFGPIKKYSKDGKGAEIYQVKYISDKLGNHLDISDKYNVENGNKKVVLLQISPYRTDVYQSKETGLYNFITIRRYHIYQENDMNIIKPELYQKLLSDKRIDETYEFKFSLNRNDIINLVTVDNQAKHIDEMLYRFIGTNNDKTNQIEIRYIEKMTLKQIMVSIGKKIVKFEKYNVSPTGKKAKAEKEVLKLKWK

SEQ ID NO: 8186 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVINAVIKKYGDLDSIVIEMARDRNTAEERKNIEQAQKRNQENREKAKEILDVNYSFLKLDSKLVQKIMLYNQQDGKSMYSGKPINLNVLISDPNAYEIDHIIPLSISLDDSIANKVLVYRSENQRKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNIYSEDIKISHKVDRKPNRQFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSVRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENVPMIYRFVGTNNDLKNVVEVKPIYCDKIDKPQIMKTIGKKVTKIEKFDVDVLGNKIAKKRDKCLQLEL

SEQ ID NO: 8187 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHENGEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 8188 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8189 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRIHMQAIQVVNELRKEYGEFDSIVIETTRAKNSSDEKKDIQEDKKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNQFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8190 - protein, 1071 aa, unidentified
  REGION 1..1071: note = Description of Unknown:uncultivated organism sequence
MKQNDYVLGLDIGITSVGWGIVDANSKVVAAGVRLFDENQSEKKKTNQTRREHRSSRRVKRRRKQRVVEMKRLLKREGIISDNFKPLSNPYAIRVKGLTQQLSNEELATALLHLAKRRGSSLEVVEEETTADEEKKLKATLSDNTQFLHNNNIHVCQLQLKRLNERGFVRGVDNVFKTEDYVKEAEAILKNQNKSAQFNEHAVELIARRRHFSEGPGSYESPTPYGRFRKDENGKVNEEPLNLIELMRGRCSVYPEELRAPKESFSAELHNFLNDLNNLKIHGEPQKLTPEQKQKLVSIIKEKGYLSPKNNAEKAVSKVIGISPDLISGFRQDKNEKPIITEFKGYQKFLKVLGSNNPILDNIELLDQISEILTSTKVLDERIDKITNLNTILDKKTIKDLALLPGFTQYHSFSFKALRLLNKEMMITSRNQMQIIHDQKLIKKSPIEKLVLDESLILSPVAKRAHREALKVVNELIKEFGHFRKVIIETAREKNSKEQKTLLNRMQKLNEKRNKEAEALLEGTDLEHLELNGKQKLKLRLYKEQDGKCAYTYNSLNIRAIVTNTDDYEIDHIIPYSISLDNSYQNKVLVERRANQLKGNNTPFKYFQSGRAYGQVTSYEKFKELVLANNNYSKQKKLNLTNEQDITSFDSQRGFIARNLVDTRYATRAIMTTLKEYFDSNDVPTIVYTMKGKNTNLYRQIGSYEYFKRYKFAEYNALSKDRDQYIHHAIDALICAGLAEQASLKRMYQVDRSKEIDAETGEVLSYDTSPMEDTHFLDFLVSLGQLEDKDIRFSWKVDTKPNRRFSDETIYSTRNVDGEEKVVKKYKNIYEMKNSDLEKMFKKPDKLLLFHNDPKTYEILHGIYKQYKHTPQPFASYQEEHGEKVRKYAKNGKGPFITDIKYYDSNLGNHLDISHNYKTKNKKVVLLQITPYRTDFYRRPNGKLSFVTIRLKDIKPIGDPINGQYHIPEDLYKQKLQEAGLQDAKFLYSFHRNEIIEIVKKEKDGTISRSRYRFVATNDDKAKVIEVKEISKKTEKRETPYVNSLHDIVKYAYSPIGKIKKIDSEVLKLRV

SEQ ID NO: 8191 - protein, 1067 aa, unidentified
  REGION 1..1067: note = Description of Unknown:uncultivated organism sequence
MNKGYILGLDIGVTSVGWGIIDQDHEIVDAGVRLFEEANASMNEKRREKRHARRVKRRKTQRIIEMKRHLLRHNIIGEGFKPMGNPYELRVKGLKEKLEDEEMATALLHLVKRRGSTLDTVDVTEDKEELKSKEQLSINTKKLKDEHKHVSEVQLERYNERKSIRGEDNIFKTEDYIAETTAILNTQDKSEAFNEKVIELISRKRHYSDGPGSKDSPSPYGKFRLNEEGEVEEVNLIEEMRGHCSVYKDELRAPLESFSAELFNFLNDLNNLKIIHREEEKLTVNEKETIIDKIREKGYLSPKAKPHEAIAKILNIEPETLSGFRINTKKNPIITEFKGYQKLLKVFNKHEESLIGKDKILDTISEILTSHKKPSERIEAFESLGLNELLIKDLSNLPGFEKYHSMSFKAIYEITLELLETTKNQMEIITENNLVVPEAPNKLTLDENLILSPIAKRAHRESLRVIERLTHKYGDFDKIVIETTRAKNTKEEKDDIKKLQKIREQRNEEVQELLKGYGEQANRIKGKKALKIRLYKQQDGKCAYTHNPLSLDAIVNNRDSYEIDHVLPYSVSMDNSLNNQVLCEHKANQIKGNKTPYIYFKSGQAYGEVKTFEAFKTLVLSNTKYPRRKKELLLKEEDITRFDVMQEFTERNLVDTSYAIRSLMRTLKSFYKYHEKPTKVFTVRGKVTNLYRNRAKGLFAYDHPDADFNPMEKDRSQYRHHAIDALIAARLSEQKLIKELMYMDRTKKVDIDTGEILEDDNPMFDEKLIRFLKQLSKVDDSDLKFSWKVDKKPNRPFSDETIYSTRTVNDKEWVVKKHKDIYSMESKDIKKKLIDKAKKVNLLVYKHDPKSYEKLVKAYEQYSQEKYPFAVFKDNHGYITKYSKKGNGPELKQLKYLDGKLGNHTSITHNYNSPDKKVVLLQISPYRTDFYKNADGTIKFVTVRRKDLKPINNNKQFVMDETLYEQKKLEKGITKDAAFINSFNRNEIIEITSKDKEGVKKKQYRFIVTNNDTSNSIEVKPISSESLKLRIMLTIGRKTLDITKYAVSPIGEMSKIEKESLKLVVNA

SEQ ID NO: 8192 - protein, 1067 aa, unidentified
  REGION 1..1067: note = Description of Unknown:uncultivated organism sequence
MNKGYILGLDIGVTSVGWGIIDQDHEIVDAGVRLFEEANASMNEKRREKRHARRVKRRKTQRIIEMKRHLLRHNIIGEGFKPMGNPYELRVKGLKEKLEDEEMATALLHLVKRRGSTLDTVDVTEDKEELKSKEQLSINTKKLKDEHKHVSEVQLERYNERKSIRGEDNIFKTEDYIAETTAILNTQDKSEAFNEKVIELISRKRHYSDGPGSKDSPSPYGKFRLNEEGEVEEVNLIEEMRGHCSVYKDELRAPLESFSAELFNFLNDLNNLKIIHREEEKLTVNEKETIIDKIREKGYLSPKAKPHEAIAKILNIEPETLSGFRINTKKNPIITEFKGYQKLLKVFNKHEESLIGKDKILDTISEILTSHKKPSERIEAFESLGLNELLIKDLSNLPGFEKYHSMSFKAIYEITLELLETTKNQMEIITENNLVVPEAPNKLTLDENLILSPIAKRAHRESLRVIERLTHKYGDFDKIVIETTRAKNTKEEKDDIKKLQKIREQRNEEVQELLKGYGEQANRIKGKKALKIRLYKQQDGKCAYTHNPLSLDAIVNNRDSYEIDHVLPYSVSMDNSLNNQVLCEHKANQIKGNKTPYIYFKSGQAYGEVKTFEAFKTLVLSNTKYPRRKKELLLKEEDITRFDVMQEFTERNLVDTSYAIRSLMRTLKSFYKYHEKPTKVFTVRGKVTNLYRNRAKGLFAYDHPDADFNPMEKDRSQYRHHAIDALIAARLSEQKLIKELMYMDRTKKVDIDTGEILEDDNPMFDEKLIRFLKQLSKVDDSDLKFSWKVDKKPNRPFSDETIYSTRTVNDKEWVVKKHKDIYSMESKDIKKKLIDKAKKVNLLVYKHDPKSYEKLVKAYEQYSQEKYPFAVFKDNHGYITKYSKKGNGPELKQLKYLDGKLGNHTSITHNYNSPDKKVVLLQISPYRTDFYKNADGTIKFVTVRRKDLKPINNNKQFVMDETLYEQKKLEKGITKDAAFINSFNRNEIIEITSKDKEGVKKKQYRFIVTNNDTSNSIEVKPISSESLKPQIMLTIGRKTLDITKYAVSPIGEMSKIEKESLKLIINA

SEQ ID NO: 8193 - protein, 1084 aa, unidentified
  REGION 1..1084: note = Description of Unknown:uncultivated organism sequence
MLLGMAFYNFNNRKEDSMNKGYILGLDIGVTSVGWGIIDQDHEIVDAGVRLFEEANASMNEKRREKRHARRVKRRKTQRIIEMKRHLLRHNIIGEGFKPMGNPYELRVKGLKEKLEDEEMATALLHLVKRRGSTLDTVDVTEDKEELKSKEQLSINTKKLKDEHKHVSEVQLERYNERKSIRGEDNIFKTEDYIAETTAILNTQDKSEAFNEKVIELISRKRHYSDGPGSKDSPSPYGKFRLNEEGEVEEVNLIEEMRGHCSVYKDELRAPLESFSAELFNFLNDLNNLKIIHREEEKLTVNEKETIIDKIREKGYLSPKAKPHEAIAKILNIEPETLSGFRINTKKNPIITEFKGYQKLLKVFNKHEESLIGKDKILDTISEILTSHKKPSERIEAFESLGLNELLIKDLSNLPGFEKYHSMSFKAIYEITLELLETTKNQMEIITENNLVVPEAPNKLTLDENLILSPIAKRAHRESLRVIERLTHKYGDFDKIVIETTRAKNTKEEKDDIKKLQKIREQRNEEVQELLKGYGEQANRIKGKKALKIRLYKQQDGKCAYTHNPLSLDAIVNNRDSYEIDHVLPYSVSMDNSLNNQVLCEHKANQIKGNKTPYIYFKSGQAYGEVKTFEAFKTLVLSNTKYPRRKKELLLKEEDITRFDVMQEFTERNLVDTSYAIRSLMRTLKSFYKYHEKPTKVFTVRGKVTNLYRNRAKGLFAYDHPDADFNPMEKDRSQYRHHAIDALIAARLSEQKLIKELMYMDRTKKVDIDTGEILEDDNPMFDEKLIRFLKQLSKVDDSDLKFSWKVDKKPNRPFSDETIYSTRTVNDKEWVVKKHKDIYSMESKDIKKKLIDKAKKVNLLVYKHDPKSYEKLVKAYEQYSQEKYPFAVFKDNHGYITKYSKKGNGPELKQLKYLDGKLGNHTSITHNYNSPDKKVVLLQISPYRTDFYKNADGTIKFVTVRRKDLKPINNNKQFVMDETLYEQKKLEKGITKDAAFINSFNRNEIIEITSKDKEGVKKKQYRFIVTNNDTSNSIEVKPISSESLKPQIMLTIGRKTLDITKYAVSPIGEMSKIEKESLKLVVNA

SEQ ID NO: 8194 - protein, 1067 aa, unidentified
  REGION 1..1067: note = Description of Unknown:uncultivated organism sequence
MNKGYILGLDIGVTSVGWGIIDQDHEIVDAGVRLFEEANASMNEKRREKRHARRVKRRKTQRIIEMKRHLLRHNIIGEGFKPMGNPYELRVKGLKEKLEDEEMATALLHLVKRRGSTLDTVDVTEDKEELKSKEQLSINTKKLKDEHKHVSEVQLERYNERKSIRGEDNIFKTEDYIAETTAILNTQDKSEAFNEKVIELISRKRHYSDGPGSKDSPSPYGKFRLNEEGEVEEVNLIEEMRGHCSVYKDELRAPLESFSAELFNFLNDLNNLKIIHREEEKLTVNEKETIIDKIREKGYLSPKAKPHEAIAKILNIEPETLSGFRINTKKNPIITEFKGYQKLLKVFNKHEESLIGKDKILDTISEILTSHKKPSERIEAFESLGLNELLIKDLSNLPGFEKYHSMSFKAIYEITLELLETTKNQMEIITENNLVVPEAPNKLTLDENLILSPIAKRAHRESLRVIERLTHKYGDFDKIVIETTRAKNTKEEKDDIKKLQKIREQRNEEVQELLKGYGEQANRIKGKKALKIRLYKQQDGKCAYTHNPLSLDAIVNNRDSYEIDHVLPYSVSMDNSLNNQVLCEHKANQIKGNKTPYIYFKSGQAYGEVKTFEAFKTLVLSNTKYPRRKKELLLKEEDITRFDVMQEFTERNLVDTSYAIRSLMRTLKSFYKYHEKPTKVFTVRGKVTNLYRNRAKGLFAYDHPDADFNPMEKDRSQYRHHAIDALIAARLSEQKLIKELMYMDRTKKVDIDTGEILEDDNPMFDEKLIRFLKQLSKVDDSDLKFSWKVDKKPNRPFSDETIYSTRTVNDKEWVVKKHKDIYSMESKDIKKKLIDKAKKVNLLVYKHDPKSYEKLVKAYEQYSQEKYPFAVFKDNHGYITKYSKKGNGPELKQLKYLDGKLGNHTSITHNYNSPDKKVVLLQISPYRTDFYKNADGTIKFVTVRRKDLKPINNNKQFVMDETLYEKRKKEKGIKPDSTFINSFNRNEIIEITSKDKEGVKKKQYRFIVTNDDAANKIEVKPISSESLKLRIMLTIGRKTLDITKYAVSPIGEMSKIEKESLKLIINA

SEQ ID NO: 8195 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8196 - protein, 1056 aa, unidentified
  REGION 1..1056: note = Description of Unknown:uncultivated organism sequence
MGNGLILGFDLGITSVGWGIINHDKEVIDCGVRLFEEADKDNNAKRREKRGSRRVKRRRKQRIIELKRLLMREGIINDDFHVLGNPYHLRVKGLTMKLENDELATALLHLVKRRGSSLDIVITDSSDTEGLKMKDTLKKNALMLNEKKKYVCEIQLERLLNGKKVRGEHNNFRTDDYVDELKQILSNQSISQSIKDKIIELATRKRHYSEGPGSYTSPTEYGRFRKNEDGDVYEVNLIEEMRGHCSIYTDELRAPSSSFSALKFNLLNELNNLSFINSDFKWTKEKKDEIVRIVKEKGFLSPKSNPAKALSKLIGVEEKNITGFRINKSKKPLITDFSEYQKLLKVLKDGKSNIYNDEKVIDKISEILTSHKTESERVEKLVTILPESDLVKKIASLPGFTKYHRLSFKAIYLLNDELLYQNKNQMELINEMNLADTQAKAKLEIIDTGPMSPVVKRVQREAIKVLKELQTDYGHFDKIVIETTRAKNSKEVKDKIRRSQKYFEDLRKKAKELLGDLNVEKMSGKLVQKIMLYNEQNGKCAYTGNTLSLKAIATHSDDYEIDHIIPYSISLDNSQNNKVLVERKANQLKSNMSPFGYFSSGKAYGKISSFGQFKKIVNGNTNYNKRKRQLLLLMEDIDKYEVKDDFLQRNLVDTSYSIRQFMTALRNFYKSNNFDTKVFAIKGKHTSLFRNRAAYEYGKDLLKDMTNPLIKDRDYYRHHAIDALIVAMLSEQKLLKQLIKDERNQQLDEETGELYYKNPVLDKTFVKQLSYLGEIRDEQIKFSWKVDKKVNRSFSNETIYSTRYHQDNEYIVKKYDIYEMSQKEIERRLINEKERCLMYKHDKRTYDKVIKAYEQYKTEKLPFLAFKENQKQYITKYAKNNNGPNVKYISCLTKKLGNHIDISHNYKGNKRIILQNIPAYRIDVYQEPTGLYKFVTIRYYDLKPKGNSFEIDQSNYNSKLKQKKISSEATFKFSLHKNEVIRCVIITGKTLATYYYKFNGINDDGKNKVEVKTINSKGNKQIIVYVGSKMKQLNKFAVSPAGKFIKIENEILKMRV

SEQ ID NO: 8197 - protein, 1056 aa, unidentified
  REGION 1..1056: note = Description of Unknown:uncultivated organism sequence
MGNGLILGFDLGITSVGWGIINHDKEVIDCGVRLFEEADKDNNAKRREKRGSRRVKRRRKQRIIELKRLLMREGIINDDFHVLGNPYHLRVKGLTMKLEHDELATALLHLVKRRGSSLDIVITDSSDTEGLKMKDTLKKNALMLNEKKKYVCEIQLERLLNGKKVRGEHNNFRTDDYVDELKQILSNQSLSQSIKDKIIELATRKRHYSEGPGSYTSPTEYGRFRKNEDGDVYEVNLIEEMRGHCSIYTDELRAPSSSFSALKFNLLNELNNLSFINSDFKWTKEKKDEIVSIVKEKGFLSPKSNPAKALSKLTGVEEKNITGFRINKSKKPLITDFSEYQKLLKVLKDGKSNIYNDEKVIDKISEILTSHKTESERVEKLVTILPESDLVKKIASLPGFTKYHRLSFKAIYLLNDELLYQNKNQMELINEMNLADTQDKAKLEIIDTGPMSPVVKRVQREAIKVLKELQTDYGHFDKIVIETTRAKNSKEVKDKIRRSQKYFEDLRKKAKELLGDLNVEKMSGKLVQKIMLYNEQNGKCAYTGNTLSLKAIATHSDDYEIDHIIPYSISLDNSQNNKVLVERKANQLKSNMSPFGYFSSGKAYGKISSFGQFKKIVNGNTNYNKRKRQLLLLMEDIDKYEVKDDFLQRNLVDTSYSIRQFMTALRNFYKSNNFDTKVFAIKGKHTSLFRNRAAYEYGKDLLRDMTNPLIKDRDYYRHHAIDALIVAMLSEQKLLKQLIKDERNQQLDEETGELYYKNPVLDKTFVKQLSYLGEIRDEQIKFSWKVDKKVNRSFSNETIYSTRYHQDNEYIVKKYDIYEMSQKEIERRLINEKERCLMYKHDKRTYDKVIKAYEQYKTEKLPFLAFKENQKQYITKYAKNNNGPNVKYISCLTKKLGNHIDISHNYKGNKRIILQNIPAYRIDVYQEPTGLYKFVTIRYYDLKPKGNSFEIDQSNYNSKLKQKKISSEATFKFSLHKNEVIRCVIITGKTLATYYYKFNGINDDGKNKVEVKTINSKGNKQIIVYVGSKMKQLNKFAVSPAGKFIKIENEILKMRV

SEQ ID NO: 8198 - protein, 1056 aa, unidentified
  REGION 1..1056: note = Description of Unknown:uncultivated organism sequence
MGNGLILGFDLGITSVGWGIINHDKEVIDCGVRLFEEADKDNNAKRREKRGSRRVKRRRKQRIIELKRLLMREGIINDDFHVLGNPYHLRVKGLTMKLEHDELATALLHLVKRRGSSLDIVITDSSDTEGLKMKDTLKKNALMLNEKKKYVCEIQLERLLNGKKVRGEHNNFRTDDYVDELKQILSNQSLSQSIKDKIIELATRKRHYSEGPGSYTSPTEYGRFRKNEDGDVYEVNLIEEMRGHCSIYTDELRAPSSSFSALKFNLLNELNNLSFINSDFKWTKEKKDEIVRIVKEKGFLSPKSNPAKALSKLIGVEEKNITGFRINKSKKPLITDFSEYQKLLKVLKDGKSNIYNDEKVIDKISEILTSHKTESERVEKLVTILPESDLVKKIASLPGFTKYHRLSFKAIYLLNDELLYQNKNQMELINEMNLADTQAKAKLEIIDTGPMSPVVKRVQREAIKVLKELQTDYGHFDKIVIETTRAKNSKEVKDKIRRSQKYFEDLRKKAKELLGDLNVEKMSGKLVQKIMLYNEQNGKCAYTGNTLSLKAIATHSDDYEIDHIIPYSISLDNSQNNKVLVERKANQLKSNMSPFGYFSSGKAYGKISSFGQFKKIVNGNTNYNKRKRQLLLLMEDIDKYEVKDDFLQRNLVDTSYSIRQFMTALRNFYKSNNFDTKVFAIKGKHTFLFRNRAAYEYGKDLLRDMTNPLIKDRDYYRHHAIDALIVAMLSEQKLLKQLIKDERNQQLDEETGELYYKNPVLDKTFVKQLSYLGEIRDEQIKFSWKVDKKVNRSFSNETIYSTRYHQDNEYIVKKYDIYEMSQKEIERRLINEKERCLMYKHDKRTYDKVIKAYEQYKTEKLPFLAFKENQKQYITKYAKNNNGPNVKYISCLTKKLGNHIDISHNYKGNKRIILQNIPAYRIDVYQEPTGLYKFVTIRYYDLKPKGNSFEIDQSNYNSKLKQKKISSEATFKFSLHKNEVIRCVIITGKTLATYYYKFNGINDDGKNKVEVKTINSKGNKQIIVYVGSKMKQLNKFAVSPAGKFIKIENEILKMRV

SEQ ID NO: 8199 - protein, 1056 aa, unidentified
  REGION 1..1056: note = Description of Unknown:uncultivated organism sequence
MGNGLILGFDLGITSVGWGIINHDKEVIDCGVRLFEEADKDNNAKRREKRGSRRVKRRRKQRIIELKRLLMREGIINDDFHVLGNPYHLRVKGLTMKLENDELATALLHLVKRRGSSLDIVITDSSDTEGLKMKDTLKKNALMLNEKKKYVCEIQLERLLNGKKVRGEHNNFRTDDYVDELKQILSNQSISQSIKDKIIELATRKRHYSEGPGSYTSPTEYGRFRKNEDGDVYEVNLIEEMRGHCSIYTDELRAPSSSFSALKFNLLNELNNLSFINSDFKWTKEKKDEIVRIVKEKGFLSPKSNPAKALSKLIGVEEKNITGFRINKSKKPLITDFSEYQKLLKVLKDGKSNIYNDEKVIDKISEILTSHKTESERVEKLVTILPESDLVKKIASLPGFTKYHRLSFKAIYLLNDELLYQNKNQMELINEMNLADTQDKAKLEIIDTGPMSPVVKRVQREAIKVLKELQTDYGHFDKIVIETTRAKNSKEVKDKIRRSQKYFEDLRKKAKELLGDLNVEKMSGKLVQKIMLYNEQNGKCAYTGNTLSLKAIATHSDDYEIDHIIPYSISLDNSQNNKVLVERKANQLKSNMSPFGYFSSGKAYGKISSFGQFKKIVNGNTNYNKRKRQLLLLMEDIDKYEVKDDFLQRNLVDTSYSIRQFMTALRNFYKSNNFDTKVFAIKGKHTSLFRNRAAYEYGKDLLRDMTNPLIKDRDYYRHHAIDALIVAMLSEQKLLKQLIKDERNQQLDEETGELYYKNPVLDKTFVKQLSYLGEIRDEQIKFSWKVDKKVNRSFSNETIYSTRYHQDNEYIVKKYDIYEMSQKEIERRLINEKERCLMYKHDKRTYDKVIKAYEQYKTEKLPFLAFKENQKQYITKYAKNNNGPNVKYISCLTKKLGNHIDISHNYKGNKRIILQNIPAYRIDVYQEPTGLYKFVTIRYYDLKPKGNSFEIDQSNYNSKLKQKKISSEATFKFSLHKNEVIRCVIITGKTLATYYYKFNGINDDGKNKVEVKTINSKGNKQIIVYVGSKMKQLNKFAVSPAGKFIKIENEILKMRV

SEQ ID NO: 8200 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVVASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8201 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQISPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8202 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENIITDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHENGEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 8203 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLANAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADDYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 8204 - protein, 1069 aa, unidentified
  REGION 1..1069: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYSLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHENGEVEVIHSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTMHKDVEKRKEEIKKINNTEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEEQKNIEQVKKRNQENREKAKEIIEVNHSFSKLDSKLVQKIMLYNQQDGKSMYSGKPINLNVLISDREAYEIDHIIPLSISLDDSIANKVLVYKSENQQKLNNTPLQYLRSGNSNGWSVDEFREVVIKMYNDKKISLKKLQNLLCEKDITKYDVRKGFIERNLVDTRYASRVVLGLLKDYFKANNKNTKVFTVRGQITSQFRRAKNLKKDRNYFYHHIVDALIIAHFRKFNYISELMQYGFNYKEKIDEETGELIQYNDTLFPKKDDDFTIQLRKLNDLNIYSENIKISHKVDRKPNRQFSDETIYSARKIDNDYMKILKYKDIYGEEGKKFAKKIKDNLQKENELDIFLMKKVDPETFNLLVSIVKNTICGEKENPFVKYCEENNIDFIRKKSKNGNGPIIRSIRYYKKIESDYLDVSNKYINLPYNKKVLLDSTKNFRIDFYKSKNGIYKFLVIKYYYIDKINNKYYIPLNIYEKLKKDRCINDSDEFLFSVYKNEYLRITTKDSKKNVPNIYRFIGTTHNTIELKPLYCDEEQEKKRNRPTIGKKITKIEKFDVDVLGNKIAKKRDKCLQLEL

SEQ ID NO: 8205 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLANAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENDEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNIEFSEEDIVKLSEITGIQQYHSLSYKAMKVIIPELYENPENQMEVITRLNLVKTSIDDLKGRTTIPSYSDRIYSPVAKRVHNETIKVINAVIKKYGDLDSIVIEMARDRNTAEERKNIEQAQKRNQENREKAKEILDVNHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNIYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYSNLPNDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCNKIDKPQIMKTIGKKVTKIEKFDVDVLGNKIAKKRDKCLQLEL

SEQ ID NO: 8206 - protein, 1071 aa, unidentified
  REGION 1..1071: note = Description of Unknown:uncultivated organism sequence
MAKYILGLDMGITSVGWGLIDYDSGKIVDKGVRLFKEATAKDNLKRRTHRGSRRLKRRRQQRIIELKRLLKKENILTDDYTPLNNVYYLRCKGLNEKLANAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENDEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNIEFSEEDIVKLSEITGIQQYHSLSYKAMKVIIPELYENPENQMEVITRLNLVKTSIDDLKGRTTIPSYSDRIYSPVAKRVHNETIKVINAVIKKYGDLDSIVIEMARDRNTAEERKNIEQAQKRNQENREKAKEILDVNHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNIYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYSNLPNDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCNKIDKPQIMKTIGKKVTKIEKFDVDVLGNKIAKKRDKCLQLEL

SEQ ID NO: 8207 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVYMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8208 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNAELVSVLLHIAKIRGSSLEVVEDDEKKANEDKSSKANLSANEVKLRTSKEEICEKQYKDLIENGKVRGINNIYKSSSYESELKKILANQGLSKEVNDKIINIIFRRRDFNEGPGSMESPTIYGRFIPHENGEVEVIHSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTMHKDVEKRKEEIKKINNTEFSEEDIVKLSEITGIQQYHSLSYKAMKVIIPELYENPENQMEVITRLNLVKTSIDDLKGRTTIPSYSNRIYSPVAKRVHNETIKVINAVIKKYGDLDSIVIEMARDRNTAEERKNIEQAQKRNQENREKAKEILNVNYSFSKLDSKLVQKIMLYNQQDGKSMYSGKPINLNVLISDPNAYEIDHIIPLSISLDDSIANKVLVYRSENQQKLNKTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNKYSEDIKISHKVDRKPNRKFSDETIYSAIKIGNDYMKISKYKDIYGEEGKKFAKKIKDNLQKENELDIFLMKKVDPETFNLLVSIVKNTICGEKENPFVKYCEENNIDFIRKKSKNGNGPIIRSIRYYDGKVNSYQDISQKYSNLSDDKKVVRLHISPYRTDFYLTKEGNYKFLTIKYANIKENHNGYYIPKEVYETLKKSKKINDSDEFLFSLYRNDYLRITTNDPTENAPMIYRFVGTKKDLNNVIEVKPIYCDKIDKPQIEKTIGKKVTKIEKFDVDVLGNKIAKKRDKCLQLEL

SEQ ID NO: 8209 - protein, 1069 aa, unidentified
  REGION 1..1069: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADDYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNHSFSKLDSKLVQKIMLYNQQDGKSMYSGKPINLNVLISDREAYEIDHIIPLSISLDDSIANKVLVYKSENQQKLNNTPLQYLRSGNSNGWSVDEFREVVIKMYNDKKISLKKLQNLLCEKDITKYDVRKGFIERNLVDTRYASRVVLGLLKDYFKANNKNTKVFTVRGQITSQFRRAKNLKKDRNYFYHHIVDALIIAHFRKFNYISELMQYGFNYKEKIDEETGELIQYNDTLFPKKDDDFTIQLRKLNDLNIYSENIKISHKVDRKPNRQFSDETIYSARKIDNDYMKISKYKDIYGEEGKKFAKKIKDNLQKENELDIFLMKKVDPETFNLLVSIVKNTICGEKENPFVKYCEENNIDFIRKKSKNGNGPIIRSIRYYKKIESDYLDVSNKYINLPYNKKVLLDSTKNFRIDFYKSKNGIYKFLVIKYYYIDKINNKYYIPLNIYEKLKKDRCINDSDEFLFSVYKNEYLRITTKDSKKNVPNIYRFIGTTHNTIELKPLYCDEEQEKKRNRPTIGKKITKIEKFDVDVLGNKIAKKRDKCLQLEL

SEQ ID NO: 8210 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDRKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8211 - protein, 1057 aa, unidentified
  REGION 1..1057: note = Description of Unknown:uncultivated organism sequence
MGYILGLDLGITSVGFDIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVYMQAIQVVNELRKEYGEFDSIVIETTRTKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLIDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKYGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKTEKEVLKLKWK

SEQ ID NO: 8212 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDRDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8213 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDKKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8214 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFLLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8215 - protein, 960 aa, unidentified
  REGION 1..960: note = Description of Unknown:uncultivated organism sequence
MTNLELANVLVNLAKRRGSSLDVAVDEDDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGPKIKFDSSAILSPVTKRVHMQAIQVVNELRKEYGEFDSIVIETTRAKNSSDEKKDIQEDQKKLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLCDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKEGESLKKLFDDKKEQTLLMARNDIQTFELFKKIYENYKNEKNPFAKYKEEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKRIDETYEFKFSLNRNDIINLVTVDNQADHINEMLYRFIGTNNDKTNKIEIRYIEKMTLKRIMVSIGKKIVKFEKYNVSPTGKKAKAEKEVLKLKWK

SEQ ID NO: 8216 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDKKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSKCEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8217 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8218 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8219 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFNILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8220 - protein, 960 aa, unidentified
  REGION 1..960: note = Description of Unknown:uncultivated organism sequence
MTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLKEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8221 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNIISNVNFDILDNVYELRVKGLTQKLTNLELANVLVNLAKRRGSSLDVAVDEDDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGPKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFANQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKRIDETYEFKFSLNRNDIINLVTVDNQAKHIDEMLYRFIGTNNDKTNQIEIRYIEKMTLKQIMVSIGKKIVKFEKYNVSPTGKKAKAEKEVLKLKWK

SEQ ID NO: 8222 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8223 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8224 - protein, 856 aa, unidentified
  REGION 1..856: note = Description of Unknown:uncultivated organism sequence
MRRRNFSEGPGSYEFPTKYGSYRVDYVDGIKTIKHVNLIEEMRCKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCHEKGSKIKFDSSAILSPVTKRVYMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8225 - protein, 634 aa, unidentified
  REGION 1..634: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKIIF

SEQ ID NO: 8226 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8227 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNYNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKSELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8228 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYIDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNILTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8229 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNIYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8230 - protein, 1071 aa, unidentified
  REGION 1..1071: note = Description of Unknown:uncultivated organism sequence
MARYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKAYEDKSSKANLSANEVKLRTSKEEICEKQYKDLIENGKVRGINNIYKSSSYESELKKILANQGLSKEVNDKIINIIFRRRDFNEGPGSIESPTIYGRFIPHENGEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTVEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSADEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDGFTIQLRKLNDFNKYSEDIKISHKIDRKPNRQFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLNISPYRTDFYLTKEGNYKFLTIKYANIKENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 8231 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8232 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEAGLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8233 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADDYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 8234 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSFEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGPEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8235 - protein, 1067 aa, unidentified
  REGION 1..1067: note = Description of Unknown:uncultivated organism sequence
MAKYILGLDMGITSVGWGLIDYDSGKIVDKGVRLFKEATAKDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHENGEVEVIHSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTMHKDVEKRKEEIKKINNTEFSEEDIVKLSEITGIQQYHSLSYKAMKVIIPELYENPENQMEIITRLNLVKTSIDDLKGRTTIPSYSDRIYSPVAKRVHNETIKVINAVIKKYGDLDSIVIEMARDRNTAEEQKNIEQVKKRNQENREKAKEIIEVNHSFSKLDSKLVQKIMLYNQQDGKSMYSGKPINLNVLISDREAYEIDHIIPLSISLDDSIANKVLVYKSENQQKLNNTPLQYLRSGNSNGWSVDEFREVVIKMYNDKKISLKKLQNLLCEKDITKYDVRKGFIERNLVDTRYASRVVLGLLKDYFKANNKNTKVFTVRGQITSQFRRAKNLKKDRNYFYHHIVDALIIAHFRKFNYISELMQYGFNYKEKIDEETGELIQYNDTLFPKKDDDFTIQLRKLNDLNIYSENIKISHKVDRKPNRQFSDETIYSARKIDNDYMKISKYKDIYGEEGKKFAKKIKDNLQKENELDIFLMKKVDPETFNLLVSIVKNTICGEKENPFVKYCEENNIDFIRKKSKNGNGPIIRSIRYYDGKVNSYQDISQKYSNLSDDKKVVRLQISPYRTDFYLTKEGNYKFLTVKYANIKENHNGYYIPKEVYESLKKSKKINDSDEFLFSLYRNDYLRISTNDPAENAPMIYRFVETTDDLKNVVKVEPIYCEIYIRKTIGKKITKIEKFDVDVLGNKIAKKRDKCLQLEL

SEQ ID NO: 8236 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADDYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVINAVIKKYGDLDSIVIEMARDRNTAEERKNIEQAQKRNQENREKAKEILNVNYSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKYDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 8237 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHENGEVEVIHSMIEKMQGKCSIYLNEPRAAKMSFTADLFNFLNDLNNLEIQRADNYDNYITPDEKKIIINEYIIKKGKITIQKLCDVLQVKKENITGFRVNKGEPILTEFKGYQKVLKALNRIIDTEIVDAVIDVLTMHKDVEKRKEEIKKINNTEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQRKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFIIQLRKLNDLNKYSEDIKISHKVDRKPNRQFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSVRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENVPMIYRFVGTNNDLKNVVEVKPIYCDKIDKPQIMKTIGKKVTKIEKFDVDVLGNKIAKKRDKCLQLEL

SEQ ID NO: 8238 - protein, 1016 aa, unidentified
  REGION 1..1016: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYNLLELIMIRQIKLRLDILKK

SEQ ID NO: 8239 - protein, 735 aa, unidentified
  REGION 1..735: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKYVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKD

SEQ ID NO: 8240 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGAEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8241 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8242 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKYSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVYMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLIDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKYGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8243 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8244 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISHKYNVENGNKKVVLPQNSPYRTDVYQSKETGLYNFITIRRYHIYQENDMNIIKSELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8245 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSANEVKLRTSKEEICEKQYKDLIENGKVRGINNIYKSSSYESELKKILANQGLSKEVNDKIINIIFRRRDFNEGPGSIESPTIYGRFIPHENGEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTVEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSADEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDFNKYSEDIKISHKIDRKPNRQFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLNISPYRTDFYLTKEGNYKFLTIKYANIKENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 8246 - protein, 624 aa, unidentified
  REGION 1..624: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLKIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNIIRVLHQQKKIKIKENEHLGSIFHLVWFQNAKDQLMIGSPLKHLLIV

SEQ ID NO: 8247 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGTSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8248 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDEDDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8249 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVNKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFEIFKKIYENYKNEKNPFAKYKDEFGPIKKYSKDGKGSEIYQVKYISDKLGNHLDISHKYNVENGNKKVVLLQNSPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 8250 - protein, 1069 aa, unidentified
  REGION 1..1069: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYSLRCKGLNEKLTNAELVSVLLHIAKIRGSSLEVVEDDEKKANEDKSSKANLSVNETKLRTSKEEICEKQYKDLIENGKVRGINNIYKSSSYESELKKILANQGLSKEVNDKIINIIFRRRDFNEGPGSMESPTIYGRFIPHKNGEVEVIHSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTMHKDVEKRKEEIKKINNTEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEEQKNIEQVKKRNQENREKAKEIIEVNHSFSKLDSKLVQKIMLYNQQDGKSMYSGKPINLNVLISDREAYEIDHIIPLSISLDDSIANKVLVYKSENQQKLNNTPLQYLRSGNSNGWSVDEFREVVIKMYNDKKISLKKLQNLLCEKDITKYDVRKGFIERNLVDTRYASRVVLGLLKDYFKANNKNTKVFTVRGQITSQFRRAKNLKKDRNYFYHHIVDALIIAHFRKFNYISELMQYGFNYKEKIDEETGELIQYNDTLFPKKDDDFTIQLRKLNDLNIYSENIKISHKVDRKPNRQFSDETIYSARKIDNDYMKILKYKDIYGEEGKKFAKKIKDNLQKENELDIFLMKKVDPETFNLLVSIVKNTICGEKENPFVKYCEENNIDFIRKKSKNGNGPIIRSIRYYKKIESDYLDVSNKYINLPYNKKVLLDSTKNFRIDFYKSKNGIYKFLVIKYYYIDKINNKYYIPLNIYEKLKKDRCINDSDEFLFSVYKNEYLRITTKDSKKNVPNIYRFIGTTHNTIELKPLYCDEEQEKKRNRPTIGKKITKIEKFDVDVLGNKIAKKRDKCLQLEL

SEQ ID NO: 8251 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGDVFDYSQDPFDDHRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8252 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDITDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8253 - protein, 1071 aa, unidentified
  REGION 1..1071: note = Description of Unknown:uncultivated organism sequence
MARYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSANEVKLRTSKEEICEKQYKDLIENGKVRGINNIYKSSSYESELKKILANQGLSKEVNDKIINIIFRRRDFNEGPGSIESPTIYGRFIPHENGEIEIIPSMIEKMQGKCSIYQNEPRAAKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTVEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSADEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDFNKYSEDIKISHKIDRKPNRQFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLNISPYRTDFYLTKEGNYKFLTIKYANIKENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 8254 - protein, 1055 aa, unidentified
  REGION 1..1055: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDKDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8255 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRCKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKMIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCKEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8256 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQSQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKWSKIKFDSSAILSPVAKRVHMQAIQVVNELRKEYGEFDSIVIETTRAKNSSDEKKDIQEDKKRLEEQKRKSDELLIDLDKNPDNYNTLTKLKLRLYKEQEGKTIYACLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8257 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNIYELRAKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVAKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYCVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8258 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADDYDNYITPDEKKLIINEYIIKKGKITIQKLCDVLQVKKENITGFRVNKGEPILTEFKGYQKVLKALNRIIDTEIVDAVIDVLTKYKDVEKRKEEIKKISNAEFSEEDIVKLSEITGIQQYHSLSYKAMKVIIPELYENSENQMEVITRLNLVKTSIDDLKGRTTIPSYSDRIYSPVAKRVHNETIKVINAVIKKYGDLDSIVIEMARDRNTAEERKNIEQAQKRNQENREKAKEILDVNHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENVPMIYRFVGTNNDLKNVVEVKPIYCDKIDKPQIMKTIGKKVTKIEKFDVDVLGNKIAKKRDKCLQLEL

SEQ ID NO: 8259 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQDDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8260 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDKKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYSKDGKGPEIYQVKYISDKLGNHLDISDKYNVENGNKKVVLLQISPYRTDVYQSKETGLYNFITIRRYHIYQENDMNIIKPELYQKLLSDKKNDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8261 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGAKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYDVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8262 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEVQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDITDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKTEKEVLKLKWK

SEQ ID NO: 8263 - protein, 1071 aa, unidentified
  REGION 1..1071: note = Description of Unknown:uncultivated organism sequence
MAKYILGLDMGITSVGWGLIDYDSGKIVDKGVRLFKEATAEDNLKRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADDYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVINAVIKKYGDLDSIVIEMARDRNTAEERKNIEQAQKRNQENREKAKEILDVNHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENVPMIYRFVGTNNDLKNVVEVKPIYCDKIDKPQIMKTIGKKVTKIEKFDVDVLGNKIAKKRDKCLQLEL

SEQ ID NO: 8264 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNTELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDANHSFSKLDSKLVQKIMLYNQQDGKSMYSGKPINLNVLISDPNAYEIDHIIPLSISLDDSIANKVLVYRSENQQKLNNTPLQYLRSGNSNGWSADEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDFNKYSEDIKISHKIDRKPNRQFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLNISPYRTDFYLTKEGNYKFLTIKYANIKENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 8265 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNTELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSADEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDFNKYSEDIKISHKIDRKPNRQFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLNISPYRTDFYLTKEGNYKFLTIKYANIKENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 8266 - protein, 763 aa, unidentified
  REGION 1..763: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYFKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYIS

SEQ ID NO: 8267 - protein, 634 aa, unidentified
  REGION 1..634: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFNILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKIIF

SEQ ID NO: 8268 - protein, 1057 aa, unidentified
  REGION 1..1057: note = Description of Unknown:uncultivated organism sequence
MGYILGLDLGITSVGFGIIEEDTYKIIKYGVRLFDEGTADNNLTRRQNRSSRRLKSRRKNRINAIKYLLLNNNVIPNVNFDILDNVYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVYMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLIDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKYGKGPEIYQVKYISDKLGNHLDISDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 8269 - protein, 1057 aa, unidentified
  REGION 1..1057: note = Description of Unknown:uncultivated organism sequence
MGYILGLDLGITSVGFGIIEENTYKIIKYGVRLFDEGTADNNLTRRQNRSSRRLKSRRKNRINAIKYLLLNNNVIPNVNFDILDNIYELRVKGLTQKLTNLELANVLVNLAKRRGSSLDVAVDENDNESVVAASALTKNTAELKKNNLYICQAQLAKIKSGVKLRNHDNIYKSDDYEKELRQILSNQDLSNELNDKIVEIIMRRRNFSEGPGSYEFPTKYGSYRVDYVDGIKTIKHVNLIEEMRGKCSIFRNEPRIAKCSFEACLFNLLNDLNNLTINGNGKITKEQKLQIINDYVIPKGKITIPQLVKYLGVEEKDITGFRKNKSEKNIITTFDTYSKMINFLPKDILNVTAYVDSIIELLTKTAVVEERIEEIKKLNLGLNDDIINQLANMTKVNGYHSLSKKAMDIIIPEMIETDKNQMQIIHDNNLDKNDCQEKGSKIKFDSSAILSPVTKRVHMQAIQVVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNSLKISKNKKNNLLNQEDVTKFDNMKAFVARNLSDTSYGVRTVMNTMQQYFNDNNINTNVFTVKGRLTNIFRSRVGLKKDRDYFIHHAVDALIIAGSKNQSVFNNAYLLSSTKDGILIKKTGEVFDYSQDPFDDPRFLNYISSLKKIEGKPEDFSYKVDKKTNRQFADQTIYSTRNYDGVDYVVKKYKDIYGKDGESLKKLFDDKKEQTLLMARNDIQTFELFKKIYENYKNEKNPFAKYKDEFGPIKKYCKDGKGPEIYQVKYISDKLGNHLDITDKYNVENGNKKVVLLQISPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKTEKEVLKLKWK

SEQ ID NO: 8270 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIVNIIFRRRDFNEGPGSIESPTIYGRFIPHENGEIEIIPSMIEKMQGKCSIYQDEPRAPKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDVNYSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFSYKVKIDEETGELIQYNDTLFSTKDDDFTIQLRKLNDLDKYSEDIKISHKVDRKPNRQFSDETIYSARKINNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYVNLSDDKKVVLLQISPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 8271 - protein, 1071 aa, unidentified
  REGION 1..1071: note = Description of Unknown:uncultivated organism sequence
MAKYILGLDMGITSVGWGLIDYDSGKIVDKGVRLFKEATAEDNLNRRTHRGSRRLKRRRQQRIIELKRLLKKENILTDDYTPLNNVYYLRCKGLNEKLTNAELVSVLLHIAKIRGSSLEVVEDDEKKANEDKSSKANLSVNETKLRTSKEEICEKQYKDLIENGKVRGINNIYKSSSYESELKKILDNQGLSKEVNDKIINIIFRRRDFNEGPGSIESPTIYGRFIPHENGEIEIIPSMIEKMQGKCSIYQDEPRAPKMSFTADLFNFLNDLNNLEIQRADNYDNYITPDEKKLIINEYIIKKGKITIQKLCDVLQVKKENITGFRVNKGEPILTEFKGYQKVLKALNRIIDTEIVDAVIDVLTKYKDVEKRKEEIKKINNAEFSEEDIVKLSEITGIQQYHSLSYKAMKVIIPELYENPENQMEVITRLNLVKTSIDDLKGRTTIPSYSDRIYSPVAKRVHNETIKVVNAVIKKYGDLDSIVIEMARDRNTAEERKNIEQAQKRNQENREKAKEILDANHSFSKLDSKLVQKIMLYNQQDGKSMYSGKPINLNVLISDPNAYEIDHIIPLSISLDDSIANKVLVYRSENQQKLNNTPLQYLRSGNSNGWSVDEFREVVIKMYNDKKISLKKLQNLLCEKDITKQDVRKEFIERNLVDTRYASRVVLGLLKDYFKANNKNTKVFTIRGQITSQFRKSRNLVKSRDCFYHHIVDALIIAYFRKFNYINELMQYNFNYKGKIDEETGELIQYNDTLFSTKDDDFTIQLRKLNDLNKYSEDIKISHKVDRKPNRKFSDETIYSARKIDNDYMKISKYKDIYGEEGKKFAKVIKDNLQKEKDLDKFLMKKVDPETFNLLVSIVINTTCGEKENPFVKYCEENNIDFIRKKSKNGNGPIIRSIRYYDGKVNSHLDISQKYSNLPNDKKVVLLQISPYRTDFYLTKEGNYKFLTIRYANIRENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 8272 - protein, 1097 aa, unidentified
  REGION 1..1097: note = Description of Unknown:uncultivated organism sequence
MNKKILGVDIGVASVGWGIIDQDNNVVATGVRLFQEADNSSNEERRNFRGNRRLKSRRKIRIKDMRDLLVEYNIIGKDEDVSSINPYEARYKGLTQKLTNKELASALLHIAKRRGSSLEVAEEESTNKDVSPKKILADNKLELMDKYVVEVQLERLEKGKIRNQKNIFKTEDYVKEVKQIFKNQNLSEPFKEEAIAIIERRRHFSEGPGSEKSPTPYGRWRVIEEDLKNKIVKNFSKEEKNNFGAKKFVTNYDDVSYVVLKNKTIINKKPLNLIDLMRGKCSVYSDELRAPKNSYSALIYNLLDEINNMTIVSRENGKFTKEEKEKAIQVIKENGRFKPNNIDGFLKLFDLTIEDIVGYRINANEKPIITEFKTFKELLDIFKDEGVELTEQKADSIADILTKTQVVEERKDEVVKIVNNENLALKIANLKGYNGYHAFSFKALKLLKEELLNTNLNQQQILSAQSLREEKPITKLILDETLILSAVARRAHREALKVINELIREFGNFDRIVIETTREKNSKEATARHTKNQKRFIEQKTEAIELLKEAGFSDNDYSNQTALKVRLYNEQNGKCAYSGMPLELVKVVTDPKAYEIDHIIPRSISQDNSLNNKVLVLHEVNQAKGNRTPFQYFSSGLAKKSYPINNYNAFKEYVNGNVNYQKNAFKRRNLLNEEDITKYDVLREFSNRNLIDTSYAARSLMTTIKNYFKANNIETTVLTIRGKQTDMFRGIARGLWNQEHRHISPEFNPFNKDRNYYNHHALDALIIAGLSNQKTLKYLFDLETTKKETYVTKKDTGEVFDLDPAEDSSLLKFLKNVGNLDDKDIRFSWKVDKKINRSFSNQTIYSTRKYDNDEYLIQTHKNIYEMKQEDLSKIFEDEKESEKLLIYQHDRGTFDLIKKAYLQYKHEKFPLKAYMEQHGKIKKNGVGPYVTNLKYRKEKLGNHIDITKSTTKNKKEVLLQIRPYRTDIYKDSNDNYKFVTIRYADFSSDAKGYYIDKNLYAEKLQQKGISENFKFTNSFHTNEIIAFKRKDEEFGYYRFVGTNNDVTNQIEIKSINKKDNKRNKPAIGKKIEKIYKYAVSPAGRIKRVENERLTLVR

SEQ ID NO: 8273 - protein, 1112 aa, unidentified
  REGION 1..1112: note = Description of Unknown:uncultivated organism sequence
MENNNLVLGIDVGITSVGWGIVKTRSEGPTDYLIVDHGVRLFEEAKLAADRRGIRSTRRVKRRKRQRLDDLRELLVRNQIIEKDFRPLNNPYDIRAKGLSEKLSNAELATALLHIAKRRGPDFETIEESDAKLSESQSTKSQLSKNRQRLNELKYVCLVQLERLKEIGKIRANDNTFTSSDYKNELSKILEVSNIENNLAQEIIEIILRRRSFEHGPGSLKSPTEYGRFKPVEGDLKDEIYDFLLEDSRFLKDSFIFDYKNKEYFINKSGIIVNNKPYNLVDLMRGKCSLFPNEYRAPKQAPSAMKFNLINDLVNLRISTQGDRRLTKEEINKVLDYLKKELRFTKGVNTLLKILNLEDDIVTGFRIDTKDKEIITDYEFIHSKFKSLELTEQEREVLNNISLLDHIAEILTNTKTVESRIDELSKVVDDNLAEKLANLTGFSMYHSLSFKAINELIPEMIENQANQQEIITRTYRNNDTIKELKFDEESILSPATKRSHRQAINVIKELINKYGNFDSIVIETARESNSKAERDSIRDSQKVNKKRRDDALNLIKERYGDEIESQVNITNTLINKIMHYIEQDSKCIYTGDVIDLYSLIFDPTAYEIDHIIPYSISRDNSYNNKVLVTSFANQQKVNNTPFMAYKKGLFTSSKINNYELFKDMVNSNKKIHRDKKANLLFEKDINSYTVQQSFIERNLNDTRYASRSILNTLQEYFISNDIKTKVYAVRGKNTSYIRGIGIKRWRNEDVKSPLIKDRNKHIHHAIDALIVAGLSRQEYFNARPHIYKYNDLYREKEVITPISYNIERDSYITKLINELNLINYTDTKVSYKIDQMPNKQFFDQTIYSTRNIDGKDFTLRKIKDIYSLTSKDIEDNIIKNKEKLLMYNQDIKTYDLMVQAYEQYKHEKKPFEAFKINNDGVGIRKYSKKGNGPEIKSLRYVDKGLGEHFDISHKYDVKDGKKVVQLSLNPYRADIYKLENGSYKMAIIRYSDLRQLDNERYIIDEEIYNNILSSVGIDKGDQFQFSIYKNTIIKYYTNDEELTYRAIGFSGNRIEVKGLYENYGRYNSEGNFVMDRVRITIGAKNPKKLEKYNVSIIGQTSKVESEPLQLII

SEQ ID NO: 8274 - protein, 1094 aa, unidentified
  REGION 1..1094: note = Description of Unknown:uncultivated organism sequence
MERKFVLGLDIGIASVGWGIIELSTGIVVDKGVRIFPERTAAENAKRRQLRGARRLIRRRRQRIDDLRKILVENNIINDSFRPLEHPYEIRCEGLKRTLSNEELATALLHIAKRRGSFLEFDRIDKKDVVSLDDYYKIAAKTDLSGGVVEDSEEKAKENLATKAILDANSKLLKMHNIHVCELQLMRLRENGKIRANQNNFKVIEYLRELLAIFEKQTISEELKVSIIDIIFRKREYYDGPGSKKSPTPYGRYILKNGKITEYDLIEKMRGKCTLFPDEPRAPKMSYTADLFNFLNDLNNLNINGKKITTEQKKEIVEKFINEKGEISPEKLCSYLEVDPALVSGFRVKNYETPILTTFEGYKKLSKVVKNKNNPLPKEIIENKDYVDAVIDILTRKKGKNERIEELKKIDSAIFNDFVAEKLAGISGITQYHSLSLKAIKMMLPDLWNTNDNQMQIITKMNLLAGRKEIYKGQKDIPFDDKLILSPVAKRAMNEAIKIINAVRDRYGELDSIVIEMARERNSDEEKKSIKKLNKFFADLKEKARETIKGYNVELNAKLVNKIRFYNEQDCKCLYTGKAIDLELLLKDPKAYEIDHIIPISISLDDSMQNKVLVCADANRDKENMTPFKYFASGKATGWNYEEYKEYVINLHKRKAISKKKLQNLLFEEDITKYDVQKKFIQRNLVDTRYASRAILNVLQSYFKANDIKTKVFTVRGSFTNMFRKKANLQKNRDFFYHHIVDALIVASIKKLNYMDHLLNIGISKDNTAYDKETGEVLTVMNEKKFFPPDFINFLNKLRGINDATDYIKVNISHKVDRKPNRQFTDQTIYGVRIINDDYWRIGKIKDIYGDEGKKLVEDIKKGKTDRYLMKQNDPETFALLEKIVETTPVDKNENPFLKYKSEHGFIRKRSKKGEGPIVKSLKYKFDVISNYVDITHKYDVKNDKVKVVLLSVTTYRIDIYKSRVSGLYNFVTIRNHNIKSNNEGFYIDECFYNSEKARKGITDEFEFQFSLHKNEVVELTKDEPALLRFVGVNSERINRLEFKPLHCDRLVINEKEKRIRIDINKNVLNICKYNVDVLGNLYQVSQEELKLKF

SEQ ID NO: 8275 - protein, 1097 aa, unidentified
  REGION 1..1097: note = Description of Unknown:uncultivated organism sequence
MNKKILGIDIGVASVGWGIIDQDNNVVATGVRLFQEADNSSNEERRNFRGNRRLKSRRKIRIKDMRDLLVEYNIIGKDEDVSSINPYEARYKGLTQKLTNKELASALLHIAKRRGSSLEVAEEESTNKDVSPKKILADNKLELMDKYVVEVQLERLEKGKIRNQKNIFKTEDYVKEVKQIFKNQNLSEPFKEEAIAIIERRRHFSEGPGSEKSPTPYGRWRVIEEDLKNKIVKNFSKEEKNNFGAKKFVTNYDDVSYVVLKNKTIINKKPLNLIDLMRGKCSVYSDELRAPKNSYSALIYNLLDEINNMTIVSRENGKFTKEEKEKAIQVIKENGRFKPNNIDGFLKLFDLTIEDIVGYRINANEKPIITEFKTFKELLDIFKDEGVELTEQKADSIADILTKTQVVEERKDEVVKIVNNENLALKIANLKGYNGYHAFSFKALKLLKEELLNTNLNQQQILSAQSLREEKPITKLILDETLILSAVARRAHREALKVINELIREFGNFDRIVIETTREKNSKEATARHTKNQKRFIEQKTEAIELLKEAGFSDNDYSNQTALKVRLYNEQNGKCAYSGMPLELVKVVTDPKAYEIDHIIPRSISQDNSLNNKVLVLHEVNQAKGNRTPFQYFSSGLAKKSYPINNYNAFKEYVNGNVNYQKNAFKRRNLLNEEDITKYDVLREFSNRNLIDTSYAARSLMTTIKNYFKANNIETTVLTIRGKQTDMFRGIARGLWNQEHRHISPEFNPFNKDRNYYNHHALDALIIAGLSNQKTLKYLFDLETTKKETYVTKKDTGEVFDLDPAEDSSLLKFLKNVGNLDDKDIRFSWKVDKKINRSFSNQTIYSTRKYDNDEYLIQTHKNIYEMKQEDLSKIFEDEKESEKLLIYQHDRGTFDLIKKAYLQYKHEKFPLKAYMEQHGKIKKNGVGPYVTNLKYRKEKLGNHIDITKSTTKNKKEVLLQIRPYRTDIYKDSNDNYKFVTIRYADFSSDAKGYYIDKNLYAEKLQQKGISENFKFTNSFHTNEIIAFKRKDEEFGYYRFVGTNNDVTNQIEIKSINKKDNKRNKPAIGKKIEKIYKYAVSPAGRIKRVENERLTLVR

SEQ ID NO: 8276 - protein, 1055 aa, unidentified
  REGION 1..1055: note = Description of Unknown:uncultivated organism sequence
MEYILALDMGITSVGYAIIEKDTYKIITYGVRMFDESDKKTNEDRRNFRGVRRLKSRRKNRIMAIKYLLVKYGIIDSIDFEILNNIYEIRVKGLTEKLTNLELANVLVNFAKRRGSSLEIAVEEGTEDAASASALSSNSIYLKKNNMYICQYQLEKLKNGEKLRTNDNVFRSIDYQKELEKILSNQGLTEEINNEIINIVMRRRDFSEGPGSEKFPTKYGSYRLEYKDGEYVINHVNLIDVMRGKCSIFKDEPRIAKNTYTACLFNFLNDLNNLKIDGNTKITQEQKEKIINDYINVKGKITVKQLCKFLSVDEENVSGFRIDTKGKNIITTFDGYEKLLSIVPENVLNNKDNVDNIIEILTKTLVVEKRIEEIKLLNLALNDDQINKIANLTRINGYHSLSKKAMNIIIPELLQTSMNQMQIIQKNSLSGNTFNYEGPNIPVDNNLILSSVAKRVNRQTINLVNKLRKEYGEFESIVIETTRSKNSDDERNRIKEEQKRFAENKERTEKILLDLEKNPSDYNTITKLKVSLYMQQRGKTMYAGLPIDLDLLLNDETAYQIEHIIPYSISFDNSLNNKALASESENKEKGKMTPWEFFSSGKVSKYNGTIRTWNEYEAFVNSLQISKKRKENLLNQKDVSKFINMEEFVARNLVDTSYGIRSVMNEMKQYFKANNIDTKIFTTKGKFTHDFRNRVGLVKNRDEYIHHAIDALIIAGSRNQKVFNNAYKLYTDNDGNTEIVETGEIFDYSQDPFDDSRFIKFLKELKQIEGKPEDFSWKVDTKTNRSFADQTIYSTRRINDKDYVIKKYKDIYGKEGESLKDLFAKNKAKEKLLMAKNDIKTFELFEKIYESYKDFKNPFLKYKEEFGYIRKYSKNGDGPVISQVKYIDSALESHLDVSSNYTVKNGKKVVLLQNSPYRTDIYITKDGLYKMLTIKRYHISQCGNKNIIKKEVYDELMKLKKINEEDEFLFSLNRYNIINVLNKSDVENGEKQKLYRFIATNNDNKNIIEVKLIEKKDETRQMKTIGKSIILIEKYNVSATGKMSKVVKEELKLEW

SEQ ID NO: 8277 - protein, 1067 aa, unidentified
  REGION 1..1067: note = Description of Unknown:uncultivated organism sequence
MNKGYILGLDIGVTSVGWGIIDQDHEIVDAGVRLFEEANASMNEKRREKRHARRVKRRKTQRIIEMKRHLLRHNIIGEGFKPMGNPYELRVKGLKEKLEDEEMATALLHLVKRRGSTLDTVDVTEDKEELKSKEQLSINTKKLKDEHKHVSEVQLERYNERKSIRGEDNIFKTEDYIAETTAILNTQDKSEAFNEKVIELISRKRHYSDGPGSKDSPSPYGKFRLNEEGEVEEVNLIEEMRGHCSVYKDELRAPLESFSAELFNFLNDLNNLKIIHREEEKLTVNEKETIIDKIREKGYLSPKAKPHEAIAKILNIEPETLSGFRINTKKNPIITEFKGYQKLLKVFNKHEESLIGKDKILDTISEILTSHKKPSERIEAFESLGLNELLIKDLSNLPGFEKYHSMSFKAIYEITLELLETTKNQMEIITENNLVVPEAPNKLTLDENLILSPIAKRAHRESLRVIERLTHKYGDFDKIVIETTRAKNTKEEKDDIKKLQKIREQRNEEVQELLKGYGEQANRIKGKKALKIRLYKQQDGKCAYTHNPLSLDAIVNNRDSYEIDHVLPYSVSMDNSLNNQVLCEHKANQIKGNKTPYIYFKSGQAYGEVKTFEAFKSLVLSNTKYPRRKKELLLKEEDITRFDVMQEFTERNLVDTSYAIRSLMRTLKSFYKYHEKPTKVFTVRGKVTNLYRNRAKGLFAYDHPDADFNPMEKDRSQYRHHAIDALIAARLSEQKLIKELMYMDRTKKVDIDTGEILEENNPMFDEKLIRFLKQLSKVDDSDLKFSWKVDKKPNRPFSDETIYSTRTVNDKEWVVKKHKDIYSMESKDIKKKLIDKAKKVNLLVYKHDLKSYEKLVKAYEQYSQEKYPFAVFKDNHGYITKYSKKGNGPELKQLKYLDGKLGNHTSITHNYNSPDKKVVLLQISPYRTDFYKNADGTIKFVTVRRKDLKPINNNKQFVMDETLYEQKKLEKGITKDAAFINSFNRNEIIEITSKDKEGVKKKQYRFIATSNDTSNSIEVKPISSESLKPRIMLTIGRKTLDITKYAVSPIGEMSKIEKESLKLVVNA

SEQ ID NO: 8278 - protein, 1067 aa, unidentified
  REGION 1..1067: note = Description of Unknown:uncultivated organism sequence
MNKGYILGLDIGVTSVGWGIIDQDHEIVDAGVRLFEEANASMNEKRREKRHARRVKRRKTQRIIEMKRHLLRHNIIGEGFKPMGNPYELRVKGLKEKLEDEEMATALLHLVKRRGSTLDTVDVTEDKEELKSKEQLSINTKKLKDEHKHVSEVQLERYNERKSIRGEDNIFKTEDYIAETTAILNTQDKSEAFNEKVIELISRKRHYSDGPGSKDSPSPYGKFRLNEEGEVEEVNLIEEMRGHCSVYKDELRAPLESFSAELFNFLNDLNNLKIIHREEEKLTVNEKETIIDKIREKGYLSPKAKPHEAIAKILNIEPETLSGFRINTKKNPIITEFKGYQKLLKVFNKHEESLIGKDKILDTISEILTSHKKPSERIEAFESLGLNELLIKDLSNLPGFEKYHSMSFKAIYEITLELLETTKNQMEIITENNLVVPEAPNKLTLDENLILSPIAKRAHRESLRVIERLTHKYGDFDKIVIETTRAKNTKEEKDDIKKLQKIREQRNEEVQELLKGYGEQANRIKGKKALKIRLYKQQDGKCAYTHNPLSLDAIVNNRDSYEIDHVLPYSVSMDNSLNNQVLCEHKANQIKGNKTPYIYFKSGQAYGEVKTFEAFKTLVLSNTKYPRRKKELLLKEEDITRFDVMQEFTERNLVDTSYAIRSLMRTLKSFYKYHEKPTKVFTVRGKVTNLYRNRAKGLFAYDHPDADFNPMEKDRSQYRHHAIDALIAARLSEQKLIKELMYMDRTKKVDIDTGEILEDDNPMFDEKLIRFLKQLSKVDDSDLKFSWKVDKKPNRPFSDETIYSTRTVNDKEWVVKKHKDIYSMESKDIKKKLIDKAKKVNLLVYKHDPKSYEKLVKAYEQYSQEKYPFAVFKDNHGYITKYSKKGNGPELKQLKYLDGKLGNHTSITHNYNSPDKKVVLLQISPYRTDFYKNADGTIKFVTVRRKDLKPINNNKQFVMDETLYEQKKLEKGITKDAAFINSFNRNEIIEITSKDKEGVKKKQYRFIATNNDTLNSIEVKPISSESLKPQIMLTIGRKTLDITKYAVSPIGEMSKIEKESLKLVVNA

SEQ ID NO: 8279 - protein, 1067 aa, unidentified
  REGION 1..1067: note = Description of Unknown:uncultivated organism sequence
MNKGYILGLDIGVTSVGWGIIDQDHEIVDAGVRLFEEANASMNEKRREKRHARRVKRRKTQRIIEMKRHLLRHNIIGEGFKPMGNPYELRVKGLKEKLEDEEMATALLHLVKRRGSTLDTVDVTEDKEELKSKEQLSINTKKLKDEHKHVSEVQLERYNERKSIRGEDNIFKTEDYIAETTAILNTQDKSEAFNEKVIELISRKRHYSDGPGSKDSPSPYGKFRLNEEGEVEEVNLIEEMRGHCSVYKDELRAPLESFSAELFNFLNDLNNLKIIHREEEKLTVNEKETIIDKIREKGYLSPKAKPHEAIAKILNIEPETLSGFRINTKKNPIITEFKGYQKLLKVFNKHEESLIGKDKILDTISEILTSHKKPSERIEAFESLGLNELLIKDLSNLPGFEKYHSMSFKAIYEITLELLETTKNQMEIITENNLVVPEAPNKLTLDENLILSPIAKRAHRESLRVIERLTHKYGDFDKIVIETTRAKNTKEEKDDIKKLQKIREQRNEEVQELLKGYGEQANRIKGKKALKIRLYKQQDGKCAYTHNPLSLDAIVNNRDSYEIDHVLPYSVSMDNSLNNQVLCEHKANQIKGNKTPYIYFKSGQAYGEVKTFEAFKSLVLSNTKYPRRKKELLLKEEDITRFDVMQEFTERNLVDTSYAIRSLMRTLKSFYKYHEKPTKVFTVRGKVTNLYRNRAKGLFAYDHPDADFNPMEKDRSQYRHHAIDALIAARLSEQKLIKELMYMDRTKKVDIDTGEILEDDNPMFDEKLIRFLKQLSKVDDSDLKFSWKVDKKPNRPFSDETIYSTRTVNDKEWVVKKHKDIYSMESKDIKKKLIDKAKKVNLLVYKHDPKSYEKLVKAYEQYSQEKYPFAVFKDNHGYITKYSKKGNGPELKQLKYLDGKLGNHTSITHNYNSPDKKVVLLQISPYRTDFYKNADGTIKFVTVRRKDLKPINNNKQFVMDETLYEQKKLEKGITKDATFINSFNRNEIIEITSKDKEGVNKKQYRFIATNTDTLNRIEVKPISSESLKPRIMLTIGRKTLDITKYAVSPIGEMSKIEKESLKLVVNA

SEQ ID NO: 8280 - protein, 1111 aa, unidentified
  REGION 1..1111: note = Description of Unknown:uncultivated organism sequence
MIELTLYLNSHLSVLLKKWRNCMSNIIVGLDIGITSVGWAVTNEETGEILDSGVRLFKEGDASENAKRRSFRSGRRLKRRRVQRMKDFVELCLKEGVISEDYIILNNPLECREKGLTQQLSGQELFTALYHIVKKRGSSLEVVEDNDIKDEESAKKSLSENDKLIASGLCVCQIQLQRLKEFGSFKGHQNIFRTKHYLSEAEIILKNQNVSEDFKESVLELIKRRRKFTDGPGSMKSPSVYGRFIMQEDGSIETVDLIEKMRGRCSIYPEEFRAPKNAPSAELFNLLNDLNNLKVNDEPLTSHEKREIIRLLVHEDKHHSVTMTKLCKILNVTQEEVKGYRIDKNEKPIFTDFKGLKAFLSYITEDNKPFFLDNFSLIDQIMEALTSSKVIEDRMRFLKSLQENIPMLTENEIKQLSQIPGISGYHSLSLKAIYQINNEMFDTSDNQMQVIHRLHLGSYSTEHLIGLKEIPYDRNAILSPVAKRSQQEAIKVVNQIRKHYGEVKKIFVELAREKNSDEQKSLINKAQKNFENLNKSLKSDFGVEELSSKTRLKLRLYKEQDGKCVYTGECLDPKLIISDPNAYDIDHIIPLSVSLDDSMANKVLVFNDANRAKGNLTPIQAFRMGKFNGWNETQYRTFVSNLAAYKYGFNKKKLGYLLDEREITSYSNMKDFIARNLVDTRYASRVVLNTLQDYFSANQIPTKVVPINGQITSMLRGKIGIKKSRDENYFHHAIDAATLTLLSQQSHFSKVFDNIQIDNKDISIDTDGIPVYDYKDFLTETFMQKLVPLRKLAEEHEFKDGVPFNFIESKIKISHKVDKKPNRAVSDQTIYSTRQTEDGERVVKKYKNIYDPKFMNLAEDIIEGNVNHYLMKRHDPQSFSKFEEIVDQYMKEFKQLNDNPLYLYKEKHGTVRKFSKNGNGPEIISLKYLENKLNSHVKITQNYKTIDNTEKQKNVVLLQIKPYRTDFYVNEKGQYKFVTIRMNDVRYSGEKKLFVIEKEWYENEKTRKGVDKTFNFVFSMHRDELMYLEKIERNRDKSETVFKDVWRFVATNDDDKNVIQYNFTHYNASKQERITIGGKIKKIAKVHTDILGKLYESKDNKLKLEFTIDKI

SEQ ID NO: 8281 - protein, 1094 aa, unidentified
  REGION 1..1094: note = Description of Unknown:uncultivated organism sequence
MERKFVLGLDIGVASVGWGIIELSTGIVVDKGVRIFPERTAAENAKRRQLRGARRLIRRRRQRIDDLRKILVENNIINDSFRPLEHPYEIRCEGLKRTLSNEELATALLHIAKRRGSFLEFDRIDKKDVVSLDDYYKIAAKTDLSGGVVEDSEEKAKENLATKAILDANSKLLKMHNIHVCELQLMRLRENGKIRANQNNFKVIEYLRELLAIFEKQTISEELKVSIIDIIFRKREYYDGPGSKKSPTPYGRYILKNGKITEYDLIEKMRGKCTLFPDEPRAPKMSYTADLFNFLNDLNNLNINGKKITTEQKKEIVEKFINEKGEISPEKLCSYLEVDPALVSGFRVKNYETPILTTFEGYKKLSKVVKNKNNPLPKEIIENKDYVDAVIDILTRKKGKNERIEELKKIDSAIFNDFVAEKLAGISGITQYHSLSLKAIKMMLPDLWNTNDNQMQIITKMNLLAGRKEIYKGQKDIPFDDKLILSPVAKRAMNEAIKIINAVRDRYGELDSIVIEMARERNSDEEKKSIKKLNKFFADLKEKARETIKGYNVELNAKLVNKIRFYNEQDCKCLYTGKAIDLELLLKDPKAYEIDHIIPISISLDDSMQNKVLVCADANRDKENMTPFKYFASGKATGWNYEEYKEYVINLHKRKAISKKKLQNLLFEEDITKYDVQKKFIQRNLVDTRYASRVILNVLQSYFKANDIKTKVFTVRGSFTNMFRKKANLQKNRDFFYHHIVDALIVASIKKLNYMDHLLNIGISKDNTAYDKETGEVLTVMNEKKFFPPDFINFLNKLRGINDATDYIKVNISHKVDRKPNRQFTDQTIYGVRVINDDYWRIGKIKDIYGDEGKKLVEDIKKGKTDRYLMKQNDPETFALLEKIVETTPVDKNENPFLKYKSEHGFIRKRSKKGEGPIVKSLKYKFDVISNYVDITHKYDVKNDKVKVVLLSVKTYRIDIYKSRVSGLYNFVTIRNHNIKSNKEGFYIDECFYNSEKARKGITDEFEFLFSLHKNEVVELTKDEPALLRFVGVNTEITNRLEFKPLHCDRLVINEKKKRIRIDINKNVLNICKYNVDVLGNLYQVSKEELKLKF

SEQ ID NO: 8282 - protein, 1094 aa, unidentified
  REGION 1..1094: note = Description of Unknown:uncultivated organism sequence
MERKFVLGLDIGVASVGWGIIELSTGIVVDKGVRIFPERTAAENAKRRQLRGARRLIRRRRQRIDDLRKILVENNIINDSFRPLEHPYEIRCEGLKRTLSNEELATALLHIAKRRGSFLEFDRIDKKDVVSLDDYYKIAAKTDLSGGVVEDSEEKAKENLATKAILDANSKLLKMHNIHVCELQLMRLRENGKIRANQNNFKVIEYLRELLAIFEKQTISEELKVSIIDIIFRKREYYDGPGSKKSPTPYGRYILKNGKITEYDLIEKMRGKCTLFPDEPRAPKMSYTADLFNFLNDLNNLNINGKKITTEQKKEIVEKFINEKGEISPEKLCSYLEVDPALVSGFRVKNYETPILTTFEGYKKLSKVVKNKNNPLPKEIIENKDYVDAVIDILTRKKGKNERIEELKKIDSAIFNDFVAEKLAGISGITQYHSLSLKAIKMMLPDLWNTNDNQMQIITKMNLLAGRKEIYKGQKDIPFDDKLILSPVAKRAMNEAIKIINAVRDRYGELDSIVIEMARERNSDEEKKSIKKLNKFFAELKEKARETIKGYNVELNAKLVNKIRFYNEQDCKCLYTGKAIDLELLLKDPKAYEIDHIIPISISLDDSMQNKVLVCADANRDKENMTPFKYFASGKATGWNYEEYKEYVINLHKRKAISKKKLQNLLFEEDITKYDVQKKFIQRNLVDTRYASRVILNVLQSYFKANDIKTKVFTVRGSFTNMFRKKANLQKNRDFFYHHIVDALIVASIKKLNYMDHLLNIGISKDNTAYDKETGEVLTVMNEKKFFPPDFINFLNKLRGINDATDYIKVNISHKVDRKPNRQFTDQTIYGVRVINDDYWRIGKIKDIYGDEGKKLVEDIKKGKTDRYLMKQNDPETFALLEKIVETTPVDKNENPFLKYKSEHGFIRKRSKKGEGPIVKSLKYKFDVISNYVDITHKYDVKNDKVKVVLLSVKTYRIDIYKSRVSGLYNFVTIRNHNIKSNKEGFYIDECFYNSEKARKGITDEFEFLFSLHKNEVVELTKDEPALLRFVGVNTEITNRLEFKPLHCDRLVINEKKKRIRIDINKNVLNICKYNVDVLGNLYQVSKEELKLKF

SEQ ID NO: 8283 - protein, 1094 aa, unidentified
  REGION 1..1094: note = Description of Unknown:uncultivated organism sequence
MERKFVLGLDIGVASVGWGIIELSTGIVVDKGVRIFPERTAAENAKRRQLRGARRLIRRRRQRIDDLRKILVENNIINDSFRPLEHPYEIRCEGLKRTLSNEELATALLHIAKRRGSFLEFDRIDKKDVVSLDDYYKIAAKTDLSGGVVEDSEEKAKENLATKAILDANSKLLKMHNIHVCELQLMRLRENGKIRANQNNFKVIEYLRELLAIFEKQTISEELKVSIIDIIFRKREYYDGPGSKKSPTPYGRYILKNGKITEYDLIEKMRGKCTLFPDEPRAPKMSYTADLFNFLNDLNNLNINGKKITTEQKKEIVEKFINEKGEISPEKLCSYLEVDPALVSGFRVKNYETPILTTFEGYKKLSKVVKNKNNPLPKEIIENKDYVDAVIDILTRKKGKNERIEELKKIDSAIFNDFVAEKLAGISGITQYHSLSLKAIKMMLPDLWNTNDNQMQIITKMNLLAGRKEIYKGQKDIPFDDKLILSPVAKRAMNEAIKIINAVRDRYGELDSIVIEMARERNSDEEKKSIKKLNKFFADLKEKARETIKGYNVELNAKLVNKIRFYNEQDCKCLYTGKAIDLELLLKDPKAYEIDHIIPISISLDDSMQNKVLVCADANRDKENMTPFKYFASGKATGWNYEEYKEYVINLHKRKAISKKKLQNLLFEEDITKYDVQKKFIQRNLVDTRYASRVILNVLQSYFKANDIKTKVFTVRGSFTNMFRKKANLQKNRNFFYHHIVDALIVASIKKLNYMDHLLNIGISKDNTAYDKETGEVLTVMNEKKFFPPDFINFLNKLRGINDATDYIKVNISHKVDRKPNRQFTDQTIYGVRVINDDYWRIGKIKDIYGDEGKKLVEDIKKGKTDRYLMKQNDPETFALLEKIVETTPVDKNENPFLKYKSEHGFIRKRSKKGEGPIVKSLKYKFDVISNYVDITHKYDVKNDKVKVVLLSVKTYRIDIYKSRVSGLYNFVTIRNHNIKSNKEGFYIDECFYNSEKARKGITDEFEFLFSLHKNEVVELTKDEPALLRFVGVNTEITNRLEFKPLHCDRLVINEKKKRIRIDINKNVLNICKYNVDVLGNLYQVSQEELKLKF

SEQ ID NO: 8284 - protein, 1078 aa, unidentified
  REGION 1..1078: note = Description of Unknown:uncultivated organism sequence
MAKKVLGLDIGVTSVGWAIIDVDENEIIDKGVRIFPERSAQENVKRREKRGSRRLKRRRQQRLIDMKELLKKHGVIDEKFVPLKNPYEIRCKGLTEKLANDELATAILHITKRRGSSFDSIDDIEEDDEKTSSDVVDQIEVDKAPELKSTKKILDYNEKMLINKNTNYICLIQKKRLEESGSVRGSLNNFKTSEYIKEIEKILSNQGLSQDFNEKVINLIKRKRAYFEGPGSEKSPTPYGRWYYEQGEIKYVDLIEKMRGTCSLSPLEKRAPKDSYTACLFNILNDLNNLKINQEKITQEQKEQVIELMKKEKGDFTVKKLCKFLNVEETFISGFREDKNKKNLISQFTGYKKIRNVVNNEGFNKIIFENEDYVDKIVEILTVKRGIDERKNELKKINPEVFSEAVADALAQITGCKEYHSLSFKAMKKMIPDLLATTDNQMQLITKYGIQKQNIGVFKGKNEIVLDQKAIISPVALRAQNEAIKIINAIRSIHGELDTIVIEMARDKNSAEEKKRINEQQKRGEELNKQALELAEGKPLTGSLALKLRLYKEQDHRCIYTGKEIDKDLLMTDPFAYEIDHIIPISISLDDSFNNKVLTTSKINSDKTNMTPFKFFSSGKIQGVSFGEFTSRVINLEKRGLISKNKLRNLLFAEDIDKQSVRAEFINRNLVDTRYATRVILNTLTNYFRANEIDTKVHAINGRITDNIRNRAGLKKCRDFFYHHIVDAIIVAAVKKHKYFSKLLNLYESSDGIIYDNETGEIITSENQKDFFDEKLFSFLSKIRRINDLTNYDETIKISHKIDKKFNRQFTDETIYSTRLIDGVDYLVARFKDIYGEDGIKLAKMIKKDEENKILMKRNDPETFELIKQIVLKTDYTEKENPFALYKEQHGEIRKKAKNGKGPVIKSVKYLKEKLGNHHPITHKYQSVRPGNKVVLLQVSPYRTDFYVSPSGLYRFVTIRYANVKMSNKEGTIDLVEYEQMKQLKKIDDTYQFCFSLHRNETIKITKKGENPHTYRFVGTNSDKLNRIEVKELYCNVLKEERRIILTIGKEICLLEKFSCDILGNMKKIESEVLKLKI

SEQ ID NO: 8285 - protein, 1078 aa, unidentified
  REGION 1..1078: note = Description of Unknown:uncultivated organism sequence
MAKKVLGLDIGVTSVGWAIIDVDENEIIDKGVRIFPERSAQENVKRREKRGSRRLKRRRQQRLIDMKELLKKHGVIDEKFVPLKNPYEIRCKGLTEKLANDELATAILHITKRRGSSFDSIDDIEEDDEKTSSDVVDQIEVDKAPELKSTKKILDYNEKMLINKNTNYICLIQKKRLEESGSVRGSLNNFKTSEYIKEIEKILSNQGLSQDFNEKVINLIKRKRAYFEGPGSEKSPTPYGRWYYEQGEIKYVDLIEKMRGTCSLFPLEKRAPKDSYTACLFNILNDLNNLKINQEKITQEQKEQVIELMKKEKGDFTVKKLCKFLNVEETFISGFREDKNKKNLISQFTGYKKIRNVVNNEGFNKIIFENEDYVDKIVEILTVKRGIDERKNELKKINPEVFSEAVADALAQITGCKEYHSLSFKAMKKMIPDLLATTDNQMQLITKYGIQKQNIGVFKGKNEIVLDQKAIISPVALRAQNEAIKIINAIRSIHGELDTIVIEMARDKNSAEEKKRINEQQKRGEELNKQALELAEGKPLTGSLALKLRLYKEQDHRCIYTGKEIDKDLLMTDPFAYEIDHIIPISISLDDSFNNKVLTTSKINSDKTNMTPFKFFSSGKIQGVSFGEFTSRVINLEKRGLISKNKLRNLLFAEDIDKQSVRAEFINRNLVDTRYATRVILNTLTNYFRANEIDTKVHAINGRITDNIRNRAGLKKCRDFFYHHIVDAIIVAAVKKHKYFSKLLNLYESSDGIIYDNETGEIITSENQKDFFDEKLFSFLSKIRRINDLTNYDETIKISHKIDKKFNRQFTDETIYSTRLIDGVDYLVARFKDIYGEDGIKLAKMIKKDEENKILMKRNDPETFELIKQIVLKTDYTEKENPFALYKEQHGEIRKKAKNGKGPVIKSVKYLKEKLGNHHPITHKYQSVRPGNKVVLLQVSPYRTDFYVSPSGLYRFVTIRYANVKMSNKEGTIDLVEYEQMKQLKKIDDTYQFCFSLHRNETIKITKKGENPHTYRFVGTNSDKLNRIEVKELYCNVLKEERRIILTIGKEICLLEKFSCDILGNMKKIESEVLKLKI

SEQ ID NO: 8286 - protein, 1057 aa, unidentified
  REGION 1..1057: note = Description of Unknown:uncultivated organism sequence
MGYILGLDLGITSVGFGIIEEDTYKIIKYGVRLFDEGTADNNLKRRQNRSSRRLKSRRKNRINAIKYLLLNNNIISNVNFEILDNVYELRVKGLTQKLTNLELANVLVNLAKRRGSSLDVAVDEDDNESVVAASALTKNTAELKKNNLYICQAQLTKIKSGVKLRNHDNIYKSADYEKELRQILSNQDLSNELNDKIVEIIMRRRNFSEGPGSYEFPTKYGSYRVDYVDGIKTIKHVNLIEEMRGKCSIFKNEPRIAKCSFEACLFNLLNDLNNLKINGNGKITKEQKLQIINDYIIPKGKITIPQLVKYLGVEEKDITGFRKNKSEKNIITTFDTYSKMINFLPKDILNVTAYVDSIIELLTKTAVVEERIEEIKKLNLGLNDDVINQLANMTKVNGYHSLSKKAMDIIIPEMIETDKNQMQIIHDNNLDKNDCQEKGSKIKFDSSAILSPVTKRVHMQAIQIVNELRKEYGEFDSIVIETTRAKNSSDEKKDIQEDQKRLEEQKRKSDELLIDLDKNPDNYNTLTKLKLRLYKEQEGKTIYAGLPIDLDLLLNDPTAYQIEHIIPYAVSFDNSMNNKSLASAKENQDKGKRTPWQYFSSGMVSECEGPINDWESFEAFVNGLKISTNKKNNLLNQEDVTKFDNMKTFVARNLSDTSYGVRTVMNTMQQYFNDNNINTNVFTVKGRLTNIFRSRVGLKKDRDYFIHHAVDALIIAGSKNQSVFNNAYLLSTTKDGILIKKTGEVFDYSQDPFDDPRFLNYISSLKQIEGKPEDFSYKVDKKTNRQFADQTIYSTRNYDDVDYVVKKYKDIYGKDGESLKKLFDDKKEQTLLMARNDIQTFELFKKIYENYKNEKNPFAKYKEEFGPIKKYSRDGKGPEIYQVKYISDKLGNHLDISHKYNVGNGNKKVVLLQNSPYRTDVYQSKETGRYNFITIRRYHIYQENDMNIIKPELYQKLLSDKKIDATYEFKFSLNRNDIINLVTIDNQADHIDEMLYRFIGTNNDKTNKIEIRYIEKMTLKQNIVSISKKIVKFEKYNVSPTGKKAKTEKEVLKLKWK

SEQ ID NO: 8287 - protein, 1107 aa, unidentified
  REGION 1..1107: note = Description of Unknown:uncultivated organism sequence
MFNTDMKYSLGLDIGITSVGWAVIDEDKQRIHDLGVRIFERAENPKDGSSLATPRREARSARRRLKRRRRRLNALRNFFVNHNLLTNQQIDTILATPSDPYSLRVKGLDEKLTNEELFRSLYHIAKHRGYKSNRKVEKEESSTSETGRVIQALRANEALLATKGYRTVGEALLTDEKYLTHKRNKRDDYTNSFGRSDYTAEIIAIIKKQCEFGLQLTDSDVQQFIFGINETEEVISENAILYQRPFITRKLMEEMIGECTFEPSEKRAPRASYSFDMFRLASDLAHVVFKPKPGIKVEFNRITLPAEIIQKILQVAKTTKCLTYNKVRDLAGVSDDYQFDHVRGKKKSDDPYGDKNEFGSLKAYHDIKKAFVDLPEEWALIDNELSLDQIAFILTVHKDDQEMRTALEELGLSNNATEAVLSIKQTNFKTFGHLSIKAIRNITPHIIAGNTYDKAVELAGYDFKKKEVNLEHITNPVVKRAVSQAIKVVKAIERKYDKPYFMRIETARELAKNFKDRNIILKEQQENQAKNAQIIDMLKNEYHITNPTGQQIIKFKLYREQNSKSLYSGTPVDINKLFSDDNAYQIDHIIPFSRSGNDSLANKVLVTTEENQFKGNKTPYEAFGHDEQKWKQLVKNVESTYITRSLKEGNAVDKQGNYKWNGYAIKKKNNLLNQNYKNDEWNARALPNTQYITRLIANYLRQATDFAEGKEKQRVFTPNGTITAYMRRRWGLAKVREEDVLHHAADAAIVAVTTQSNIQKANLYAKSREIQRALQNAKTLKEKTDLLTGEITDENAFSKAQQEFNAHVVLSDKHFPRPWPRFDDEIRKRTLNISTDDLRNELRGLENYDEEFRMSLQPIFVSRMPNRKASGQAHKETIRSPKTKEDDKRTIRKRLVDVKLGDLEKSVLPESDKVLYNQLKVLLEKYGDDPKKAFAEPVYKNGKTHDKNGQPLSSVSTIKVYSTEPSGFLVNDGKAFVNNGSMVRLDVYQKQNAKGKVEHFFVPVYAHQIGRNRPVPTNILPAPKGFTDVDETFTKITSLFPNDYVRFYFGNEIKEGYYVKYGSAAGQIYIIQQSAANKDNLIAISARSAVSIERFDISILGDNAPRI

SEQ ID NO: 8288 - protein, 1098 aa, unidentified
  REGION 1..1098: note = Description of Unknown:uncultivated organism sequence
MKYSLGLDIGTTSIGWAVIDEDKKRIHDVGVRIFEVPEDPQSGKSLAEPRRTARSTRRRLKRRRQRLNALKNFFVKHQLLTQGDIDRLLLPENYHNPYEVRERAIAEKISNEELFIALYSIAKRRGYKSNRKSLEERDNESSRVLSAISENKAILANYSSVASALNSDDKFSSHKRNKRDSYINSFARQDFLEEAKAIINTQKSLGLALNDDAIHELLYANEHSGDFSGIFSQRPFMTSDLIKKMRGNCELEPTEFRAPRASYTFELFRLAQNLSHLRVTINRETRSLTPEEVARCIEKAKSIKTLKYSHIRDVLGYKNDESFEFARGMIRGKVKDGDKTNGEANKFDEMTFYHAIKTACKNSLLEWGNIEHDTDLLDQIGEILTVNKDDINLRNGLQKLNISAEVIAELLKLNFSGFGHLSLTALRKITPFLLGGQNYDQAVVSAGYQFTQNLSGDKRKLPPLSEQHSQQITNPVAKRAISQSIKVTNAIILKYGTPNKIKIEAASDLAKTFADRQKIKKSQDENSDYNENLKDRLINEFGVTTPTGLQITKFKLYNQQNGKCMYSGKPLDLNQLFSDERYGEIDHIIPFSRCGNDGLNNKALVLTEENQQKRNLTPYEAWGSDETKWKDFEARVVATSLPFAKKSRLLAKSLPDEDWNERAINDTRYISKFLRGYIRDNLKFADYPDEKGTQRVITPSGSITSYLRRVWHVGSKSRDENNLHHATDACIIAAVDQGTIQKVSRLNKYYELFKYADTNEVTDRITGEIIKRNELEQHTAEVEPWPEFGKEVRKRTVLYATPSELHNELIGLDNYDEAFRLSVRPIFVSRMPKRGGKGATNKETIRSPKIVADYENNKGENVVARKQRVPLTSVKLKDLYDSPIRQDTKLYEALKQRLEEFNDDPVKAFAPDNPIYKPTKDGSQGNIVRSIKIYDTQNSKTGFYINKGKAFVNNGSTVRLDVFIRKNYKGIDEYYFAPVYTHLVRAKKIEVLPTPNGRSAEEKADFNKIRETDGKIYATTENGFEKQFSIYPNDYVRIYMNNKVVEGYYVKYNINGGRVQVISHSETNKENLVALSPKTASDIKRYDISILGDNYKWL

SEQ ID NO: 8289 - protein, 1144 aa, unidentified
  REGION 1..1144: note = Description of Unknown:uncultivated organism sequence
MAQKSSYSPKKYSLGLDIGTSSVGWAVLDLDKERIHDLGVRIFERPEDPQNGDSLAKPRRDARSARRRLKRRRQRLNHLKQFFVDQNILTKDRVEEVLDYKSDFNKLDVYGLRTKALTEELSPEELLKVLYQIAKRRGFKSNRKVVEESDKEGGRVTSALKTNEKFLADNNYTTVGEALSRDEKFALHKRNKRDDYTNSFARDDFLRELEAIIKTQRNYALKNVPEPAINELIYGIDDGQVTNVSAIMYQRPFMTKELIEKMVGKCTFEDGEKRAPKASYSFEVFRLASDLSHLVFIPRDASKRQAKRDNLEVRLSPEQISKVIDVAKSQKSLTYKKVRSTAGISEDYVPKDVRGKKKDGDEFGEDNTFGGLKAYSDIRLALKDLPEDWAKIDNESAINQIAYILTTQKADEGIRAELDTLALSDKAKESIVKIKPTNFKAFGHLSIKALQKITPHILDGMTYDKACKAAGYDFKKQSASLEQITNPVVKRAIAQTLKVVRAIERKYGKSYFIKVETARDLAKNFKDRNAIKKENDENQGYNEDIKSIITDGYEASPKTKGGKQLLSHLKELNVPLNKNADFNGQQIVKIKLYREQNGVCLYSGKSIDFETMLRDDNAYQVDHIVPFSRSNNDGMTNKVLVLTEENQKKGNQTPFEYFGTDEKRWKDFAARVESIYKTRDVKTSDKATNAINYKYNGYAMKKKQNLLLQDYKNDSWNVRALNDTRYITRFIQNYLRQNVDFAEGEEKQRVIAPNGTTTAYLRKRWGLAKDRAEDVLHHAKDAAVVAAIDQKIVMQANLHAKRHEIKALLAATKTMEEKTDKLTGKITDEDEFDKAQRRKAAILVLSSKYFPQPWDNFGKEVMKRTLNTDIATLQNELRGLENYDDEFRLSIKPIFVSRMPRRKATARAHKETIRSPKVKDSDQRTVRMPLNKIKRKDVENSVLKESDKWLYDKLLKRLDTHDNNPEKAFAEPIYKNDKKFDKNGNQLSPVSTIKVYSTQPSGFYINDGKAFVNNGSMVRLDVYQKPNKKGKIEHFFVPVYAHQIGKNKLTPTKILPAPKDFTNVDETFTKVCSLYPNDYVRIYLKNEIREGYYVKYNVANGAMQLLPNYAPGKNQGTFVQVYGKNAQAIERYDISILGDNYRWL

SEQ ID NO: 8290 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKRFFRDNNLLSKEQIEELLKPENKLDPYKIREKALNEKISNDELFVGLYHIAKRRGYKSNRKSAEENDKENSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSFEKSEFRAPKASYSFEMFRLAENLAHLRVVINNEERNLTEEEISKVIEKAKDIKVLKYQHIREVLGYKKDENFSFPVNMIRGEIKKDSKNNGEENKFGELSFYHKVKAALSNTPEDWQKVCDNNYRMLDELGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKERKKIKKTQDENASYNESIKERLKNEFNVLSPTGLQITKFKLYEQQNWKCAYSGEDFVIENLFSNEHYAEIDHIIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRSGNGSINKETIRSPKIVEGYVDSKGKPAIARKQRVRLTSVDLKTLYDSPVRETDPALYEILKARLDEFDNKPEKAFGDPSNPVYKPTKNGSLGNIVRSIKVYDTQNSKSGFLINEGKAFVNNGDAIRLDVFKRKNYKGEFEYYFSPIYAHLLNAKKVEILPTPNGRSAAEKADFNKIRDENGKIFATEENGFVKQFSLYPNDYVRIYAKNKIVEGYYVKYNIANGSISLIGHDKADKKNIDGVSGGTITSIERYDISVLGDNYRWI

SEQ ID NO: 8291 - protein, 1118 aa, unidentified
  REGION 1..1118: note = Description of Unknown:uncultivated organism sequence
MTQKSSYSPKKYSLGLDIGTSSVGWAVLDLDKERIHDLGVRIFERPEVPKTGKSLAEPRRAARSTRHRLRRRRQRLNYLKRFFIDNNLISESRISDILSPTHPKKWRPAYDPYDLRIKGLEEKLSLEELFVALYHIAKRRGYKSNRISVEKQDIEGSQVLSAISENKLLLEKYKTKSVAKVLTLDEKFKNNKRNKTSTYKNSFVRKNFEDEAALLLESQKKIGLKLPYEKIQTLLYGDVKNGNYNGIFSQRPFMTEELIEEMRGYCEFEPEKHRAPKASYSFELFRLAQNLSHLRIVVDKETRQLSEDEIAKIIEKAKNVKELKYEHIRDILGYKGDQSFSFAQGMIRGKIKKDDKKNGEGNKFDSMIFYHTVKKAFEQHPKDWDILAANNFELLDNAGLILTVNKDDSSLRAKLSKLDISTDAIEALLPINVSGFAHLSFNSLHKITPWLLRGLNYSEAVEKAGYSFSQSLSGDKKRLPPLSEKQAAQITNPVVKRAVSQTIKVVNAIIRKYGIPYSVKIEAASELAKNAQERDKIKKIQDENAAYNEKIKQKLINEFNIPTPTGLQITKFKLREQQNGVSIYSGKEIRLENLFADEHYGEIDHIIPFSRCGNDGLNNKVLVFADENQEKGNLTPYETWGGDNQKWIQFEARVRATAGLPAAKRDRLLSKSKPVEDWNVRALNDTRYISRFLRQYIRDNLDFPKIEGKAGTQRVFSPSGPITSYLRRVWRVGNKHRDDNNLHHAADACIIAATDPGIIQKVSSLNKYYELFRYSNKNEVIDKLTGEVLNCNQLEQHIADLEPWHDFGKEVRKRSRLYNTPSELHGELTGLKNYDEEFRLSTLPIFVSRMPKRSGKGSTNSETFRSPKIVEGYLDEKGKPAIARKQRVPLHSVDLKKLYDSPIRETDPKLYKILEQRLKDFNGDPAKAFVESVYKPTKDSKRGNIVRSIKIYNTRDSRSGFLVNEQRAFVNNGRTIRLDVYKRKNYKDIYEYYFAPVYTHLINAQKIEVLPTPTGRSKNEKVDFDTIRTEDDKIYATLENGFIKQFSIYPNDYVRIYFDNEIVEGYYVKYNTNDGSLKLIKHSETSKNDNDLISKAAKTANLIERYDISILGDNYRWL

SEQ ID NO: 8292 - protein, 1132 aa, unidentified
  REGION 1..1132: note = Description of Unknown:uncultivated organism sequence
MTEKSSYSPKKYSLGLDIGTSSIGWAVLDLDKERIHDLGVRIFERPEDPQNGDSLAKPRRDARSARRRLKRRRQRLNHLKQFFIDRNILTKDQVEEVLDCKSDFNKLDVYKLRAKALAEELSPEELLKVLYQIAKRRGFKSNRKVVEESDKEGGRVTSALKANEKFLAGNNYTTVGDALSRDEKFALHKRNKRDDYTNSFARDDFLRELEAIIKTQRNYTLRNIPEQAINELIYGIDDGQATNVSAIMYQRPFMTKELIEKMVGDCTFEKDEKRAPKASYSFEMFRLASDLSHLVFIHRDASKRQAKRENLEVRLSSEQISKVIDLAKNQKSLTCKKVRSTAGISEDYVPKDVRGKKKEGDEFGEDNTFGGLKAYNDIRSALKDLPEDWAKIDNESAINQIAYILTTQKADEGIRAELDSLPLSDKAKEAIIKIKPTNFKAFGHLSIKALQKITPHILEGMTYDKACEAAGYDFKKQSASLEQITNPVVKRAITQTLKVVRAIERKYGKPYFIKVETARDLAKNFKDRKAIENENKENQTRNQSIIQTLNENGIVTPTGQQIIKVKLYREQNGVCLYSGKPIDFETMLRDDNAYQVDHIVPFSRSNNDGITNKVLVLTEENQKKGNQTPFEYFGVDEKRWKEYVARVESTYQTREVKKGDKDAGANYKYNGYAMKKKQNLLLQDYKNDSWNVRALNDTRYITRFIQNYLRQNVDFAEGEEKQRVIAPNGTTTAYLRKRWGLAKDRAEDVLHHAKDAAVVAAIDPKIVYQANLFSKEQEMKLYLNNAKTIDEKRQILLQSTDENTGEITDEVAFTRAQKELAQAEYFKLRSDEETKNRFPSPWPDFSKEIMKRTLNTDITTLQNELCGLDNYDEEFRLSVKPIFVSRMPRRKAVAQAHKETVRSPKVKDNDKRTVRMPLNKVKRKDIENSVLKESDKWLYDKLLERLDAHDNNPEKAFAEPVYKNDKKFDKNGKQLSPVSTIKVYSTQPSGFYINNGKAFVNNGSMVRLDVYQKPNKKGKIEHFFVPVYAHQVGKNKPTPTKILPAPKGFTDIDETFTKVCSLYPNDYVRIYLKNKILEGYYSGYDISVGTVILYPHFTPSKDIKVANRVSARSATLIERYDIAILGDNYRWL

SEQ ID NO: 8293 - protein, 1158 aa, unidentified
  REGION 1..1158: note = Description of Unknown:uncultivated organism sequence
MKYWSKALIRSLVGRIIFFMSKVFTLSNILFWLYNCIKLSQKRTIMTQKYSYSLGLDIGTSSIGWAVLDLDKERIHDLGVRIFERPEVPKTGKSLAEPRRIDRSNRHRLRRRRQRLNYLKRFFIDNNLISESRIGDMLSPTHPKKWRPIYDPYALRIKGLNERLSPEELFVALYHIAKRRGYKSNRISVEEQDIEGSQVLSAISENKLLLEKYKTKSVAKVLTLDEKFKNNKRNKINTYKNSFVRKNFEDEVMLLLDSQKKFGLKLPYEKIQTLLYGDIKNGNYNGIFSQRPFMTSELIKKMRGYCEFEPEKPRAPKASYSFELFRLAQNLSHLRIVVDRETRQLSEDEIAKIIEKAKNVKVLKYEHIRDILGYKDDQSFSFAQGMIRGKIKNDDKKNGESNKFDSMIFYHTVKKALEQHPKDWDILATNNFELLDTAGLMLTVNKDDSSLRTELSKLNISTYAVEALLPINVSGFVHLSFDSLHRITPWLLRGLNYSEAVEKAGYSFSQSLSGNKKKLPPLSEKQAAQITNPVVKRAVSQTIKVVNAIIRKYGMPYSVKIETASELAKNAQERNKIKNIQDENAEYNEKIKQKLITEFNIPTPTGLQITKFKLREQQNGVSLYSGKEINLENLFADEHYGEIDHIIPFSRCGNDGLNNKVLVFADENQEKGNLTPYEAWGGDDKKWTQFEARVRATAGLPTAKRDRLLSKSKPVEDWNVRALNDTRYISRFLRQYIRDNLDFPKIEGETGAQRVFSPSGSITSYLRRVWHVGNKNRDDNNLHHAADACIIAATSPSIIQKISSLNKYYELFKYTDKNEIVDKLTGEVLDRNQFEQHIADLEPWNDFGKEVRKRSKPYNTPSELHNELTGLKNYDEEFRLSTLPIFVSRMPKRSGKGSANDATFRSPKIVAGYIDEKGKPAIARKHRVSLHSVDLKKLYDSPIRETDPKLYKILEQRLKDFNGDPKKAFAESVYKPTKDGKRGNIVRSIKIYNTRDSRSGFLVNKQRAFVNNGKTIRLDVYKRKNYKDIYEYYFTPVYTHLINTQRIEVLPTPTGRSKNEKADFDTIRTEGNKIYATLENGFIKQFSIYPNDYVRIYFDNEIVEGYYVKYNTNDSSLKLIKHSDTSKNDSDLISKVAKTATLIERYDIAVLGDNYRWL

SEQ ID NO: 8294 - protein, 1118 aa, unidentified
  REGION 1..1118: note = Description of Unknown:uncultivated organism sequence
MTQKYSYSPKKYSLGLDIGTSSIGWAVLDLDKERIHDLGVRIFERPEVPKTGKSLAEPRRIDRSNRHRLRRRRQRLNYLKRFFIDNNLISESHISDMLSPTRPKKWRPIYDPYALRIKGLNERLSPEELFAALYHIAKRRGYKSSRISVEEQDIEGSQVLSAISENKLLLEKYKTKSVAKVLTLDEKFKNNKRNKISTYKNSFVRKNFEDEVMLLLDSQKKFGLKLPYEKIQTLLYGDVKNGNYNGIFSQRPFMTRELIEKMRGYCEFEPGKPRAPKASYSFELFRLAQNLSHLRIVVDREARQLSENEIAKIIEKAKNVKVLKYEHIRDILGYKDDQSFSFAQGMIRGKIKNDDKKNGEGNKFDSMIFYHTVKKALEQHPKDWDILATNNFELLDTAGLMLTVNKDDSSLRTELSKLNISTYAVEALLPINVSGFVHLSFDSLHRITPWLLRGLNYSEAVEKAGYSFSQSLSGNKKKLPPLSEKQAAQITNPVVKRAVSQTIKVVNAIIRKYGMPYSVKIETASELAKNAQERSKIKKIQDENAEYNEKIKQKLITEFNIPTPTGLQITKFKLREQQNGVSLYSGKEINLENLFADEHYGEIDHIIPFSRCGNDGLNNKVLVFADENQEKGNLTPYEAWGGDDKKWTQFEARVRATAGLPTAKRDRLLSKSKPVEDWNVRALNDTRYISRFLRQYIRDNLDFPKIEDKTSTQRVFSPSGPITSYLRRVWHVGNKNRDDNNLHHAADACIIAATSPSIIQKISSLNKYYELFKYTDKNEIVDKLTGEVLDRNQFEQHIADLEPWDDFGKEVRKRSKLYNTPSELHNELTGLKNYDEEFRLSTLPIFVSRMPKRSGKGSANDATFRSPKIVAGYIDEKGKPAIARKQRVSLHSVDLKKLYDSPIRETDPKLYKILEQRLKEFNGDPKKAFAESIYKPTKDGKRGNIIRSIKIYNTRDSRSGFLVNKQRAFVNNGKTIRLDVYKRKNYKGIYEYYFAPVYTHLINTQKIEVLPTPTGRSKNEKADFDTIRTEDDKIYATLENGFIKQFSIYPNDYVRIYFDNEIIEGYYVKYNTNDGSLKLIKHSDASKNDNDLISKVAKTATLIERYDISILGDNYRWL

SEQ ID NO: 8295 - protein, 891 aa, unidentified
  REGION 1..891: note = Description of Unknown:uncultivated organism sequence
MTEELIKKMVGECTFEKGEKRAPRASYSFEIFQFANNLVNLVFVPKNTNSRQAKREHFRLTLSPEQIAAVVTEAKKTASITYKKVRQVAGISEEYAPGYVRGKINKDDPYGEKNEFGKLKAYHDIKKALKSTPEDWVKVDNESTLNEIAYILTTEREDVEILKKLSGLALSDEATYAILKINPKNFRSFGHLSIKALQKITPHILSGLTYDKACEKAGYDFRRKSANLEQITNPVVKRAISQTNKIVQAVIRKYGKPYFIKVETARDLAKNFKDRKAIENENKDNQAFNSEIKEIIEHGYNIKPKTKRGKNLLEFLRENNVPLSQNIDANGQMITKVKLYREQNGKCLYSGDPIDFQAMIHDDNAYQIDHIVPFSRSNNDGLTNKVLVKTEENQEKANRTPFEYFGGDETRWKQFAARVNATYQTRDIKTSDKAINSENYKFNGYAMRKKQNLLIEEYKNDSWNTRALNDTRYITRFVQNYLRRTVSFAEGDDKQRVLAPNGTITSYLRKRWGLSKVREEDVLHHAADATIVAAIDQHVIYRANLYAKRGEVIRFLAAAKTMNEKTNKLTGEILDDDEFTKAQHRKDALQVLSDKHFPEPWSGFRDEVDLRTRNINRESLHKKLQGAHLYDENFLSEIEPIFVSRMPRRKATAQAHKETIRSPRVKDDNQRMVRMPLSKIKIKDVENSVLKESDAWLYSKLILLLEANDNNPEKAFAEPVYKNDKKFDKHGKPLMPVSTIKVYSTQPSGFLVNKGRAFVNNGSMIRLDVYQKQNQKGKIEHFFVPVYAHQVGKNQPAPTKILPAPKGFTDVDKTFTKVCSLYPNDYVRCYFKNTIEEGYYLAYDSASGQITVLGHSAANKEGDNRVRISPRSATLIRRYDISILGDNAPRP

SEQ ID NO: 8296 - protein, 886 aa, unidentified
  REGION 1..886: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKRFFRDNNLLSKEQIEELLKPENKLDPYKIREKALNEKISNDELFVGLYHIAKRRGYKSNRKSAEENDKENSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSFEKSEFRAPKASYSFEMFRLAENLAHLRVVINNEERNLTEEEISKVIEKAKDIKVLKYQHIREVLGYKKDENFSFPVNMIRGEIKKDSKNNGEENKFGELSFYHKVKAALSNTPEDWQKVCDNNYRMLDELGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKERKKIKKTQDENASYNESIKERLKNEFNVLSPTGLQITKFKLYEQQNWKCAYSGEDFVIENLFSNEHYAEIDHIIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRSGNGSINKETIRSPKIVEGYGRFERKAGYSTKTTSSINKRRFKNTLRFASS

SEQ ID NO: 8297 - protein, 1167 aa, unidentified
  REGION 1..1167: note = Description of Unknown:uncultivated organism sequence
MAQKSSYSPKKYSLGLDIGTNSIGWAVLDLEKERIHDLGVRIFSGQIENRKRRQFSSAQRINKRKKQRLKHLKTVFINNGLLSSDEINLALKDQEITENIYSLRAKAATQQISHRELFRVLYLIAKKRGFKSNRKSDPNDSDSSDTKFKKQLAKNSATAEKYQTIGLMLENDPIYANQKHNSKDNYIATFQREDIRKEVEIILNKQFEKELNAPQTSDKYRNIIEVILDETTVDDNGEKQYLGLTTQRPYTNASPIEKMTGFCEFEKTERRYVKASYTTEEYVFLSNLSNIVILDTNNNDERYYIGKDDIGRLLALAKQEKNIKCSDVRKVLSLDKSICFSSRAIEDTYRDSIKHANKKCSAPQNKEKLAEALETARKIRDRSRKSIERQKVCEKGLETFSIFKRLFKDSVLEQKIDENPYLLDDIAYILTVNIDDESIKTNLQQLEFLSDHDISVIMNMSTDDLRHFSGRSNLSHLAMQNIIKYLKEGYQSHLAIQKAGYDTKEIYQGNNITLPPLKLSDFSQDGDETFEKYGINSKVTQRALSQSIKLINAIIKKYGSPTYVRVELAREFAKTEEEREKIERNNKRNREKNREYEEIINQIFRDNHKLPPSKIGHIIRKLTLRDQQDCKDIYSGDDIDITTLVLDESAYEIDHIIPRSKRFINDMNNLVLTSTKNNREKSNRLPLSYISDPTKQKDFLGRVNLIKDKQKQKNLRLDSCEDQDNMTERALNDTKHIARFFKNYIQRNLLFAGDDEEDGRQRVFAIPGPVTAYLRARWGFEQKDRDANALHHAIDACVIVATTPKLLNRVMYHESHREQGKLYSERQSAEQDTGDFGMQAYLRAKKMYHDSIDNVSGEIIDPHKHNVAYEIMQEHEKLYRYSFPRPWIDFAREVSLRASDIDKKTLQNKLVEINNYDAEFRKTLHPIFISHMRYGKTRGSGHGEQIYKKPYKGDNRIVQHKSIYEISPEDIENSPIIVSDRKLYELLKHAFQSVELKKNQKDKDRRIDESVIIRKPSKNPDKSPIVKRIPVYMSDKPIPHDIRGGAALNGKGTVAYSILCQHTTTNHYKVVPVYFRQIHANKKTELGEGWKYISRIVPNDFVVIIKKDGSKISGYYKTRKGDTLISILPHQHSDSSKAVSQRIGTAKEIHIYNISALGDNAPEEEYK

SEQ ID NO: 8298 - protein, 1129 aa, unidentified
  REGION 1..1129: note = Description of Unknown:uncultivated organism sequence
MAQKSSYSPKKYSLGLDIGTSSVGWAVLDLDKERIHDLGVRIFERPEDPQNGDSLAKPRRDARSARRRLKRRRQRLNHLKQFFVDQNILTKDRVEEVLDYKSDFNKLDVYALRAKALTEELSPEELLKVLYQIAKRRGFKSNRKVVEESDKEGGRVTSALKANEKFLANNNYTTVGDALSRDEKFAPHKRNKRDDYTNSFARDDFLCELEAIIKTQRNYALKNVPEPAINELIYGIDDGQVTNVSAIMYQRPFMTKELIEKMVGKCTFEDGEKRAPKASYSFEVFRLASDLSHLVFIPRDASKRQAKRENLEIRLSPEQISKVIDVAKSQKSLTYKKVRSTAGISEDYVPKDVRGKKKDGDEFGEENAFGGLKAYNDIRSALKDLPEDWAKIDNESALNQIAYILTTQKADEGIRAELDVLPLSDKAKEAIVKIKPTNFKAFGHLSIKALQKITPHILEGMTYDKACEAAGYDFKKQSASLEQITNPVVKRAITQTLKVVRAIERKYGKPYFIKVETARDLAKNFKDRKAIENENKENQARNQSIIQTLNENGIVTPTGQQIIKVKLYREQQGKCLYSGNPIDFETMLRDDNAYQVDHIVPFSRSNNDGITNKVLVFTEENQKKADRTPFEYFGTDEQRWEKFVALVETTYKTRDVKTSDNATNSINYKYNGYAMKKKQNLLLQDYKNDSWNVRALNDTRYITRFIQNYLRQNVDFAEGEEKQRVIAPNGTTTAYLRKRWGLAKDRAEDVLHHAKDAAVVAAIDQKIVMQANLYAKRHEIKALLAATKTMEEKTDKLTGEITDEDEFDKAQRRKAAILVLSSKHFPQPWDNFGKEVMKRTLNTDIATLQNELRGLENYDDEFRLSIKPIFVSRMPRRKATAQAHKETIRSPKVKDGDQRTVRIPLNKLTLDTLEKSVLVESDRVLFNQLKDLLDKTATYDKKGKRTDHPDKAFAESVYKNDKKFDKNGKKLSPVSTIKVYSTQPSGFYINNGKAFVNNGSMVRLDVYQKPNKKGKIEHFFVPVYAHQVGKNKPTPTKILPAPKGFTDVDETFTKVCSLYPNDYVMCKFSENRVEEGYYVMYGIAVGQMVLLPHEVSGKDQKTMRSISPRSAASIERYDISVLGDNYRWL

SEQ ID NO: 8299 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKRFFRDNNLLSKEQIEELLKPENKLDPYKIREKALNEKISNDELFVGLYHIAKRRGYKSNRKSAEENDKENSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSFEKSEFRAPKASYSFEMFRLAENLAHLRVVINNEERNLTEEEISKVIEKAKDIKVLKYQHIREVLGYKKDENFSFPVNMIRGEIKKDSKNNGEENKFGELSFYHKVKAALSNTPEDWQKVCDNNYRMLDELGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKERKKIKKTQDENASYNESIKERLKNEFNVLSPTGLQITKFKLYEQQNWKCAYSGEDFVIENLFSNEHYAEIDHIIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRSGNGSINKETIRSPKIVEGYIDSKGKPAIARKQRVRLTSVDLKTLYDSPVRETDPALYEILKARLDEFDNKPEKAFGDPSNPVYKPTKNGSLGNIVRSIKVYDTQNSKSGFLINEGKAFVNNGDTIRLDVFKRKNYKGEFEYYFSPIYAHLLNAKKVEILPTPNGRSAAEKADFNKIRDENGKIFATEENGFVKQFSLYPNDYVRIYAKNKIVEGYYVKYNIANGSISLIGHDKADKKNIDGVSGGTITSIERYDISVLGDNYRWI

SEQ ID NO: 8300 - protein, 1045 aa, unidentified
  REGION 1..1045: note = Description of Unknown:uncultivated organism sequence
MIAKKRGFKSNRKSDPNDSDSSDTKFKKQLAKNSAIAEKYQTIGLMLENDPVYANQKHNSKDNYIATFQREDIRKEVEIIISKQFEKELNSPQISDKYKNIIETILDETTVDDSGEKQYLGMFTQRPYTNASLIEKMTGFCEFEKTERRYVKASYTTEEYIFLSNLSNIVILDTNNNDERYYIDKEDIGRLLALAKQEKNIKCSDIRKVLSLDKSICFSSRAIEDTYHDSIKHANKKYSAPQNKEKLAEALETARKIRDRSRKSIERQKVCEKGLETFCIFKRLFKDSVLERKMDENPYLLDDIAYILTVNIDDESIKTNLQQLEFLSDHDISVIMNMPNDDLRHFSGRSNLSLLAMQNIIKYLKEGYQSHLAIQKAGYDTKEIYQGNNITLPPLKLSDFSQDGDETFEKYGINSKVAQRALSQSIKLINAIIKKYGSPTYVRVELAREFARTEEEREKIERNNKRNREKNREYEEIINQIFKDNHKLPPSKIGHIIRKLTLRDQQDCKDIYSGDDIDITTLILDESAYEIDHIIPRSKRFINDMNNLVLTSTKNNREKSNRLPLSYISDPTKQKEFLERVNLIKDKQKRKNLRLDSCEDQDNMTERALNDTKHIARFFKNYIQRNLLFAGDDEENGRQRVFAIPGPVTAYLRARWGFDQKDRDANALHHAIDACVIVATTPKLLSRVMYHESHREQGKLYNERQAAKQDTGDFGMQAYLQAKKMYYDSLDRVSGEIIDPHRHNVAYKIMQEHEKRYRYSFPRPWTDFMREVSLRAGDIDKKTLQNKLVEINNYDDEFRRTLHPIFISHMRYGKTRGSGHGEQIYKKPYKDDSRIIQHKSIYDISPDDIESSPIATSDRKLYELLKDTFSKIELKGNQSEKDKRIDKNTVIYKPSKNPDKSPVVKRIPVYIDKTPIPHEVRGGAVLNEKGTVAYSILCQSSTTGHYKVVPVYFRQIHANENIELEEGWKYISRIVPNDFVVIIKKDGSKISGYYKTRKGDTLISILPHQHSDSSRAISQRIGTTKEIRIYNISVLGDNAPEEEYK

SEQ ID NO: 8301 - protein, 1133 aa, unidentified
  REGION 1..1133: note = Description of Unknown:uncultivated organism sequence
MAKKTVYLPKKYSLGLDIGTSSAGWAVLDLDKKRIHDLGVRIFERPEDSQNGDSLAKPRRDARSARRRLKRRRQRLNHLKQFFVDQNILTKNQVEEVLDYKSDFNKLDVYALRSKALAEELSPEELLKVLYQIAKRRGFKSNRKVVEESDKEGGRVTSALKTNEKFLADNNYTTVGEALSRDEKFALHKRNKRDDYTNSFARDDFLCELEAIIKTQRNYALKNVPEPAINELIYGIDDGQVTNVSAIMYQRPFMTKELIEKMVGKCTFEDGEKRAPKASYNFEVFRLASDLSHLVFIPRDASKRQAKRENLEVRLSPEQISKIINAAKSQKSLTYKKVRSIAGISEDYVPKDVRGKKKDGDKFGEKNVFGGLKAYNDIRSALKDLPEDWAKIDNESAINQIAYILTTQKADEGIRDELNLLPISNKAKEAIVKIKPTNFKAFGHLSIKALQKITPHILEGMTYDKACEAAGYDFKKQSASLEQITNPVVKRAITQTLKVVRAIERKYGKPYFIKVETARDLAKNFKDRKAIENENKENQARNQSIIQTLNENGIVTPTGQQVIKVKLYREQQGKCLYSGNPIDFETMLRDDNAYQVDHIVPFSRSNNDGITNKVLVFTEENQKKGDQTPFEYFGADEKRWKEFVARVESIYKTRDIKTSDKATNAINYKYNGYAMKKKQNLLLQDYKNDSWNVRALNDTRYITRFIQNYLRQNVDFAEGEEKQRIIAPNGTTTAYLRKRWGLAKDRTEDVLHHAKDAAVVAAIDQKIVYQANLFSKEQEMRLYLDNAKTIDEKRQILLRSTDENTGEITNETTFTQAQKDLAQAEYFKLRSDTETKNRFPAPWPDFSKEVMKRTLNTDIATLQNELRGLDKYDEEFRLSIKPIFVSRMPRRKATAQAHKETIRSPKVKDGDQRTIRMPLNKIKRKDVENSVLKESDKWLYDKLLEKLDTHGDNPEKAFAEPIYKNDKKFDKNGNQLSPVSTVKVYSTQPSGFYINDGKAFVNNGSMVRLDVYQKPNKRGKIEHFFVPVYAHQVGKNKPAPTKILPAPKGFTNIDETFTKVCSLYPNDYVRIYLKNEIREGYYVKYNVANGAMQLLPNYAPGKNQGTFIQVYGKNAQTIERYDISVLGDNCEWL

SEQ ID NO: 8302 - protein, 1139 aa, unidentified
  REGION 1..1139: note = Description of Unknown:uncultivated organism sequence
MKPSKYSLGLDIGTTSVGWAVIDLEKERIHDLGVRIFERPEDPQNGDSLAKPRRDARSARHRLKRRRQRLNYLKRFFVNEKILTQAQIAEILDPKSTYNKLDVYALRDKALNHKLTAEELFKVLYQISKRRGFKSNRKSVEETDREGGRVSKALTINEQLLAERGYKTVGQALAQDEKYTEHKRNKRDSYTNSFARADFIHELEEIIKSQRKYALNNVSDEALHSLIYGVDSDGLLTNSSAIMYQRPFMTEELIKKMVGECTFEKGEKRAPRASYSFEIFQFANNLVNLVFVPKNTNSRQAKREHFRLTLSPEQIAAVVTEAKKTASITYKKVRQVAGISEEYAPEYVRGKINKDDPYGEKNEFGKLKAYHDIKKALKSTPGDWMKVDNESTLNEIAYILTTEREDVEILKKLSGLALSDEATYAILKINPKNFRSFGHLSIKALQKITPHILSGLTYDKACEKAGYDFRRKSANLEQITNPVVKRAISQTNKIVQAVIRKYGKPYFIKVETARDLAKNFKDRKAIENENKDNQAFNSEIKEIIEHGYNIKPKTKRGKNLLEFLRENNVPLSQNIDANGQMITKVKLYREQNGKCLYSGDPIDFQAMIHDDNAYQIDHIVPFSRSNNDGLTNKVLVKTEENQEKANRTPFEYFGGDETRWKQFAARVNATYQTRDIKTSDKAINSENYKFNGYAMRKKQNLLIEEYKNDSWNTRALNDTRYITRFVQNYLRRTVSFAEGDDKQRVLAPNGTITSYLRKRWGLSKVREEDVLHHAADATIVAAIDQHVIYRANLYAKRGEVIRFLAAAKTMNEKTNKLTGEILDDDEFTKAQHRKDALQVLSDKHFPEPWSGFRDEVDLRTRNINRESLHKKLQGAHLYDENFLSEIEPIFVSRMPRRKATAQAHKETIRSPRVKDDNQRMVRMPLSKIKIKDVENSVLKESDAWLYSKLILLLEANDNNPEKAFAEPVYKNDKKFDKHGKPLMPVSTIKVYSTQPSGFLVNKGRAFVNNGSMIRLDVYQKQNQKGKIEHFFVPVYAHQVGKNQPAPTKILPAPKGFTDVDKTFTKVCSLYPNDYVRCYFKNTIEEGYYLAYDSASGQITVLGHSAANKEGDNRVRISPRSATLIRRYDISILGDNAPRP

SEQ ID NO: 8303 - protein, 1167 aa, unidentified
  REGION 1..1167: note = Description of Unknown:uncultivated organism sequence
MAQKSSYPPKKYSLGLDIGTNSIGWAVLDLEKERIHDLGVRIFSGQIENRKRRQFSSAQRINKRKKQRLKHLKTVFINNGLLSSDEINLALKDQEITENIYSLRAKAATQQISHRELFRVLYLIAKKRGFKSNRKSDPNDSDSSDTKFKKQLAKNSAIAEKYQTIGLMLENDPIYANQKHNSKDNYIATFQREDIRKEVEIILNKQFEKELNAPQTSDKYRNIIEVILDETTVDDNGEKQYLGMFTQRPYTNASLIEKMTGFCEFEKTERRYVKASYTTEEYVFLSNLSNIVILDTNNNDERYYIGKDDIGRLLALAKQEKNVKCSDVRKVLSLDKSICFSSRAIEDTYRDSIKHANKKYSAPQNKEKLAEALETARKIRDRSRKSIERQKVCEKGLGTFSIFKRLFKDSVLEQKIDENPYLLDDIAYILTVNIDDESIKTNLQQLEFLSDHDISVIMNMSTDDLRHFSGRSNLSHLAMQNIIKYLKEGYQSHLAIQKAGYDTKEIYQGNNITLPPLKLSDFSQDGDETFEKYGINSKVTQRALSQSIKLINAIIKKYGSPTYVRVELAREFAKTEEEREKIERNNKRNREKNRKYEEIINQIFKDNHKLPPSKIGHIIRKLTLRDQQDCKDIYSGDDIDITTLVLDESAYEIDHIIPRSKRFINDMNNLVLTSTKNNREKSNRLPLSYISDPTKQKEFLERVNLIKDKQKQKNLRLDSCEDQDNMTERALNDTKHIARFFKNYIQRNLLFAGDDEEDGRQRVFAIPGPVTAYLRARWGFEQKDRYANALHHAIDACVIVATTPKLLNRVMYHESHREQGKLYSERQSAEQDTGDFGMQAYLRAKKMYHDSIDNVSGEIIDPHKHNVAYEIMQEHEKLYRYSFPRPWIDFTREVSLRASDIDKKTLQNKLVEINNYDAEFRKTLHPIFISHMRYGKTRGSGHGEQIYKKPYKDDSRIIQHKSIYEISPDDIESSPIATSDRKLYELLKDTFSKIELKGNQSEKDKRIDKNTVIYKPSKNPDRSPVVKRIPVYVDKTPIPHDVRGGAVLNEKGTVAYSILCQNSTTGHYKVAPVYFRQIHANKKTELGEGWKYISRIVPNDFVVIIKKDGSKISGYYKTRKGDTLISILPHQHSDSSKAVYQRIGTAKEIHIYNISALGDNAPEEEYK

SEQ ID NO: 8304 - protein, 1118 aa, unidentified
  REGION 1..1118: note = Description of Unknown:uncultivated organism sequence
MTQKSSYSPKKYSLGLDIGTSSVGWAVLDLDKERIHDLGVRIFERPEVPKTGKSLAEPRRAARSTRHRLRRRRQRLNYLKRFFIDNNLISESRISDILSPTHPKKWRPAYDPYDLRIKGLEEKLSLEELFVALYHIAKRRGYKSNRISVEKQDIEGSQVLSAISENKLLLEKYKTKSVAEVLTLDEKFKNNKRNKTSTYKNSFVRKNFEDEAALLLESQKKIGLKLPYEKIQTLLYGDVKNGNYNGIFSQRPFMTEELIEEMRGYCEFEPEKHRAPKASYSFELFRLAQNLSHLRIVVDKETRQLSEDEIAKIIEKAKNVKELKYEHIRDILGYKGDQSFSFAQGMIRGKIKKDDKKNGEGNKFDSMIFYHTVKKAFEQHPKDWDILAANNFELLDNAGLILTVNKDDSSLRAKLSKLDISTDAIEALLPINVSGFAHLSFNSLHKITPWLLRGLNYSEAVEKAGYSFSQSLSGDKKRLPPLSEKQAAQITNPVVKRAVSQTIKVVNAIIRKYGIPYSVKIEAASELAKNAQERDKIKKIQDENAAYNEKIKQKLINEFNIPTPTGLQITKFKLREQQNGVSIYSGKEIRLENLFADEHYGEIDHIIPFSRCGNDGLNNKVLVFADENQEKGNLTPYETWGGDNQKWIQFEARVRATAGLPAAKRDRLLSKSKPVEDWNVRALNDTRYISRFLRQYIRDNLDFPKIEGKAGTQRVFSPSGPITSYLRRVWRVGNKHRDDNNLHHAADACIIAATDPGIIQKVSSLNKYYELFRYSNKNEVIDKLTGEVLNCNQLEQHIADLEPWHDFGKEVRKRSRLYNTPSELHGELTGLKNYDEEFRLSTLPIFVSRMPKRSGKGSTNSETFRSPKIVEGYLDEKGKPAIARKQRVPLHSVDLKKLYDSPIRETDPKLYKILEQRLKDFNGDPAKAFVESVYKPTKDSKRGNIVRSIKIYNTRDSRSGFLVNEQRAFVNNGRTIRLDVYKRKNYKDIYEYYFAPVYTHLINAQKIEVLPTPTGRSKNEKVDFDTIRTEDDKIYATLENGFIKQFSIYPNDYVRIYFDNEIVEGYYVKYNTNDGSLKLIKHSETSKNDNDLISKAAKTANLIERYDISILGDNYRWL

SEQ ID NO: 8305 - protein, 1130 aa, unidentified
  REGION 1..1130: note = Description of Unknown:uncultivated organism sequence
MKYSIGLDIGITSCGWSVINLDKKRIEDLGVRIFNAAEDPQRHTSLALPRREKRSSRRRFHRRRARLNYLKQFFIELNLLDESKITQLLTPHKGQLNPYILREKALKEKLSTDKLFIALYHIAKRRGYKSNHRAESGSDENENKKTLHAISENQKLLIDYQTVAKALNQNEKFAAHKRNKPNNYSNSFARADFESEITTILNKQAEFYPELTEEKINDLLYRQNYGLFFQRPFMSPELIAKMRGNCQFEKDAPRAQKASVSFEIFRLASDLVHLTYNNGQKLTPEEVAMCIEKAKDVVTFKYSHIAKILNQTHPEEIIFDYVRGLKKKDLNSDTDEAKKKTLNQKFSELKFYHAIKKALADLPEEWQKLEKNLELFNEIGFILTANKEDESVIKHLEELDLSKQAIENIASIKQNFTGFCHLSILALDKITPHILEGNTYDKAVVLAGYNFNDKLSGDQNRLPALTEEESQQITNPVTKRAVSQTIKVVNAIIRKYGAPTRLHIECASELAKSYDKRHQIEDNQKDNQATNQKIVDILKNEYHIVTPNYLQITKYKLYLEQDGKCLYSNQPIDLDRLFTDEYYCEIDHIIPKSRCGNDGLINKALVFNRENQEKRNQTPFEAWGGDTKRWQQFKTNVQSNLKIHPRKKLRLLAEVPPKEDWNSRALNDTRYITRFLSNYFKQHLKFSEDSHSKKKVFTPTGGITSYLRRIWHVGSKDRSGNLHHAVDATIIALVTEDIIKQCALMNKYIELGANYATKGINLSKFHHDIHSVINPVTGEVIDLARYEKIKEEVLPWPNFDTELRFRATPLAIFVNELPKDKKESRPELTESAKLQQKNKSINTLAEWRDQFREIYKDQDELFKNSIHPIFVSRMPKRKGTGSLHQDTVRSPKGIIVDPKTQKITANPNHSSYIRTNLENIKLADLENSIIKTDDKSLYQQLKQLLEENDNDPKKAFKEPVYKNNIKVDKNGKPLSPVRTIKLIDDKNVKSGILLSRGTQFVNNGSMVRVDIYQKEVKGKNQLFYVPIYTHQVKKGSTRILPTTCGYDYVDETFKKLFSLYPNDYIVMKKDENISQGYYIGYDTAVSSISYISNLISGNSNFNRITGRSLSSIYRLDISILGDNYPWEKLY

SEQ ID NO: 8306 - protein, 1074 aa, unidentified
  REGION 1..1074: note = Description of Unknown:uncultivated organism sequence
MRYSLGLDIGTTSVGWAVINEDRNRIEDLGVRIFERPENPKNGESLAKPRRDSRSTRRRLKRRRQRLNNLKHFFINQQLLTNEEIQDLLNPSKTAEQKAQFDPYQLREKAINSQVSPTELFVALYHIAKRRGYKSNRKKVEENSKEESGRVLMAIKQNKALLDNYRSVAIALLRDDKFKLHKRNKLDSCTNSFIREDFEKEMLAILNAQQWPDSWIEELLYSKPNGLFFQRPFMTSELIEKMRGKCPLEGTPRAQKASFSFELFRLAQDLAHLTYNDGNKLSEDQINRVVEKAKTTAKVTYKAVKEAIGFKSDPNFRFDYIRGKQTEYTEMEKREFCNLRFYHAIKKACTEIDWDRISQDLDTFDQIGYILTAYKDDESVEAELLKLNLQPETINQLESLSFSGFCGHSLTALQKLTPHLLSSKTYNQAVELEYPGQFNEKLSGENNELPSLTEAQLCQLTNPVVKRAISQTRKVINAVIHKYGAPTQIKIECANDLAKNFKERHDIKKAQDENANYNEKIIEKLKELGITTPTGTQITKYKLREQQLAKCAYCGANLTEDTLLDDRLTEIDHIIPFSRSGNDSNNNKVLVCPTCNQEKLNRTPFEKWGNDTERWLKIQALAESFNIPFAKKKRLLTEKLPKEEWGSHALNDTRYAMRFISQYIKSNLKFSDESSGKQKVLLPTGFITSYLRKMYHLGEKDRDLNNCHHAVDACIIATVSQAQIKKFAEYNKWKELGASYQTVIWYDEDGESHQKTKVEYAEMKAELLPWPRFDEEVKKRSGSTYDSSKIEKLSDFRDKFRDFDTYDETFLEKIHPLFVSRMPKRSTKGQAHKETIRSPKAEAGGRRLTRKRLSDCDLEDIKNSILPESDQALYQQLCNLYSENGKDAFKEPIYKNNQRIDKNGKAISPVKSIKVYSTEPSGILINHGTQFVNNGDTVCLNIYQRQDKFFAAPVYVHTLNRAAEILPTPNGKSKLEKADFNQLRTKDGKIFATKENGFELVMSVFPNDYIRLVYENKTVEGYYVKYGISAGTLSLISHNSTSKNDLDMIHCSVGQAVAIYKLNISVLGDNYIER

SEQ ID NO: 8307 - protein, 1118 aa, unidentified
  REGION 1..1118: note = Description of Unknown:uncultivated organism sequence
MAQKSSYSPKRYSLGLDIGTSSVGWAVLDLDKERIHDLGVRIFERPEVPKTGKSLAEPRRIARSARHRLRRRRQRLNYLKRFFIDNNLISEGRISDILSPTHPKKWRPIYDPYTLRIKGLNEKLSPEELFVALYHIAKRRGYKSNRISIEEQDVEGSQVLSAISENKLLLEKYKTKSVAKVLTLDEKFKNNKRNKTSTYKNSFVRKNFEDEVMLLLESQKKFGLKLPYEKIQTLLYGNVKNGNYNGIFSQRPFMTRELIEKMRGNCEFEPEKPRAPKASYSFELFRLAQNLSHLRIVVDQETRQLSEDEIAKIIEKAKNVKVLKYEHIRDILGYKGDQSFSFAQGMIRGKIKNDDKKNGEGNKFDSMIFYHTVKKAFEQHPKDWSILAANNFELLDRTGLILTVNKDDSSLRRELSKLNISTNAIESLLPINVSSFVHLSFESLHKITPWLLKGLNYNESVERAGYSFSQNLSGNKKELPPLSEKQAAQITNPVVKRAVSQTIKVVNAIIRKYGIPYSVKIEAANELAKNAQERDKIKKIQDENAAYNEKIKQKLINEFNIPTPTGLQITKFKLREQQNGVSIYSGKEIRLENLFADEHYGEIDHIIPFSRCGNDGLNNKVLVFADENQEKGNLTPYETWGGDNQKWIQFEARVRATAGLPAAKRDRLLSKSKPVEDWNVRALNDTRYISRFLRQYIRDNLDFPKIEGKTGTQRVFSPSGPITSYLRRVWRVGNKNRDDNNLHHATDACIIAATDPGIIQKVSSLNKYYELFKYSDKNEVIDKLTGEVLNRNQFEQHIADLEPWDDFGKEVRKRSELYNTPSELHNELTGLKNYDEEFRLSTLPIFVSRMPKRSGKGSTNSETFRSPKIIEGYLDEKGRPAIARKQRVPLRSVDLKKLYDSPIRETDPKLYKILEQRLKDFNDNPVKAFAENIYKPTKDSKCGNIVRSIKIYNTRDSKSGFLVNEQRAFVNNGKTIRLDVYKRKNYKGIYEYYFTPVYTHLINTQKIEVLPTPTGRSKKEKADFDTIRTDDGEIYATLKNGFIKQFSIYPNDYVRIYFGNEIVEGYYVKYNTNDGSLKLIKHSETSKNDNDLISKSAKTATLIKRYDISVLGDNYRWL

SEQ ID NO: 8308 - protein, 1262 aa, unidentified
  REGION 1..1262: note = Description of Unknown:uncultivated organism sequence
MDDGIKYSLGLDIGTTSVGWAVVNLDKERIEDLGVRIFERPENPKNGKSLAEPRRTARSTRRRLRRRRQRLNYLKQFFINQGLLTKQEVDNIIGSTHTKAWHQAHDPYQLRVKGLTEKLSPDELLIALYHIAKRRGYKSNRKSIEQSDTTGDGKKVNSAISKNDQILSEMKYSSVSQALLADDRFRERKRNTIDDYRYSFSRVDFLDEIRHILDRQKDFYPNELSIDHINQLLGIDVYHDENGQPIPIDHKLTNNDINRLTKHGQTTLNGIFYQRPFMTSELINHMRGKCPLEKDQPRAPKASYSFELFRLAEDLSHLQYTLDFVETGTDWQVRKERKRQAQFLTADQIKACVDKCLKTQTVKYSAIREVLGFKDDNSFQFTYIRGKSPDEKTLAKDPLAKEKNTFAQLRFYHGVKSVLKDLPDDWQDVSSDQDLFDKIGEVLTCNKDDYSIREGLIEVNKDQSAQGKAELSDEAINAIVNSKLSFAGFGHLSLVALRKITPYLLKGNGMTYDKAVEEAGYQFNAKLSGHKDLLPPLTEEQSHQITNPVVKRAVSQTIKVVNAIIHKYGAPYRIGIECAGELAKSFKEREDIKKRQDKNAENNQETVKELRSGKLVFDGEQFEAQVAPTGTSITKLNFYKQQDCKCPYCGEPLNLSKIFSDDNYAEIDHIIPFSICGNDTKANKVLVHTTCNQIKGNQTPYQTWGNDPERWKIIEATARANHKLGAAKRRRLLTQTLPDEDWSLHAINDTRYISKFISRYIKSNLKFRPMDDTDDDGHTQRQRVIMPAGAITSYLRRMWHIGHKDREEDCLHHSVDAVIVALTTQAIIQDCSVYSAYIDDHTKMQFGDNASQAGSAKLVRALQRITDPATGEIKEADYKELMQDMLPWPRFDEELRKREEQPDPVNDNLAIWRNKFSDLYKDQDSDFINRIHPIFVSRMPKRGVGGKTNEDTARSVKTKDNDDKTRSARVKLADLTLDKLNSSAIRDVDETLYGQLKQYITDRQKWQNEKNKWKAARQKQKKHLDKSSTDSEADLTLANLPPEPIEPKVYKSNKRFDKNGNPISPIKSIKVYDPHPMTSGFLVNNDTAYVNNGSMVRLDVYKHPNKKGKIEHFFVPVYAHMIKKGHPEIKPTKILPEPKKGTPTEVDDSFSFVCSLFPNDYVKVTLGSEVKEGYYVSYDIQSARITLLPHAGTSKDLPTKKKDKSSNDDQTDQSTDEADDNDKKRAKIKHPNRYPAFRIAPRSATKIERLDINVLGDNYKWG

SEQ ID NO: 8309 - protein, 1273 aa, unidentified
  REGION 1..1273: note = Description of Unknown:uncultivated organism sequence
MSIGYLTQRGYNRGMDDGIKYSLGLDIGTTSVGWAVVNLDKERIEDLGVRIFERPENPKNGKSLAEPRRTARSTRRRLRRRRQRLNYLKQFFINQGLLTKQEVDNIIGSAHTKAWHQAHDPYQLRVKGLTEKLSPDELLIALYHIAKRRGYKSNRKSIEQSDTTGDGKKVNSAISKNDQILSEMKYSSVSQALLTDDRFRERKRNTIDDYRYSFSRVDFLDEIRHILDRQKDFYPNELSIDHINQLLGIDVYHDEKGQPIPIDHKLTNNDINRLTKHGQTTLNGIFYQRPFMTSELINRMRGKCPLEKDQPRAPKASYSFELFRLAEDLSHLQYTLDFVETGTDWQVRKERKRQAQFLTADQIKACVDKCLKTQTVKYSAIREVLGFKDDNSFQFTYIRGKSPDEKTLAKDPLAKEKNTFAQLRFYHGVKSVLKDLPNDWQDVSSDQDLFDKIGEVLTCNKDDYSIREGLIEVNKDQSAQGKAELSDEAINAIVSSKLSFAGFGHLSLVALRKITPYLLKGNGMTYDKAVEEAGYQFNAKLSGHKDLLPPLTEEQSHQITNPVVKRAVSQTIKVVNAIIHKYGAPYRIGIECAGELAKSFKEREDIKKRQDKNAENNQETVKELRSGKLVFDGEQFEAQVAPTGTSITKLNFYKQQDCKCPYCGEPINLSKIFSDDNYAEIDHIIPFSICGNDTKANKVLVHTTCNQIKGNQTPYQTWGNDPERWKIIEATARANHKLGAAKQRRLLAQTLPDEDWSLHAINDTRYISKFISRYIKSNLKFRPMDDTDDDGHTQRQRVIMPAGAITSYLRRMWHIGHKDREEDCLHHSVDAVIVALTTQAIIQDCSVYSAYIDDHTKMQFGDNASQAGSAKLVRALRQITDPATGEVKEADYKELMQDMLPWPRFDEELRKREEQPDPVNDTLAIWRNKFSDLYKDQDSDFINRIHPIFVSRMPKRQGAGAVNKETVRSNKTKDDDGKTRSAKVKLRDLTLKQLSNSAISSNEGVYEQIKQYIIDRDKWKDEIKAWRKAKKASKQTSNTDEANDGKDEPSVPAEPREPKVYKADRRFDRNGNPISPIKSIKVYDPHPMTSGFLVNNDTAYVNNGSMVRLDVYKHPNKKGKIEHFFVPVYAHMIKKGHPEIKPTKILPEPKKGTPTEVDDSFSFVCSLFPNDYVKVTLGSEVKEGYYAAYDIAGCKIKLLPHAGTSKDLPTKKKDKSSNGDQTDQSTDEAGDNDKKKTKIKHPNRYPAFRIAPRSATKIERLDINVLGDNYKWD

SEQ ID NO: 8310 - protein, 1119 aa, unidentified
  REGION 1..1119: note = Description of Unknown:uncultivated organism sequence
MTEKSSYSPKKYSLGLDIGTSSIGWAVLDLDKERIHDLGVRIFERPEDPQNGDSLAKPRRDARSARRRLKRRRQRLNHLKQFFIDQNILTKDQVEEVLDYRSDFNKLDVYELRAKALTEELSPEELLKVLYQIAKRRGFKSNRKVIEESDKEGGRVTSALKANEKFLADNNYTTVGDALSRDEKFAPHKRNKRDDYTNSFARDDFLRELEFIIKNQRKYALKNIPEQAINELIYGIDDGQATNVSAIMYQRPFMTRELIEKMVGNCTFEKDEKRAPKASYSFEMFRLASDLSHLVFIHRDASKRQAKRENLEVRLSPEQISKVIDAAKSQKSLTYKKVRSTAGISEDYVPKDVRGKKKEGDEFGEDNTFGGLKAYSDIRLALKDLPEDWAKIDNESAINQIAYVLTTQKADEGIRAELDSLPLSDKAKEAIIKIKPTNFKAFGHLSIKALQNITPYILEGMTYDKACEAAGYDFKKQSASLEQITNPVVKRAITQTLKVVRAIERKCGKPYFIKVETARDLAKNFKDRKAIENENKENQARNQSIIQTLNENGVVTPTGQQIIKVKLYREQNGVCLYSGKSIDFETMLRDDNAYQVDHIVPFSRSNNDGMTNKVLVLTEENQKKSNQTPFEYFGADEKRWKEFAARVESTYKTRDTKTADKATNAINYKYNGYAIKKKQNLLLQEYKNDSWNVRALNDTRYITRFIQNYLRQDVDFTEGEEKQRVIAPNGTTTAYLRKRWGLAKDRNEDVLHHAKDAAVVAAVDQNIVRQANLFAKRSEIATLLAAAKTMEEKTDKLTGEIIDEDEFDKTQRRKDAAIVLSSKYFPQPWNNFGKEVMKRTLNTDIATLQNELRGLDNYDEDFRLSVKPIFVSRMPRRKAAAQAHKETIRSPKVKDNDQRTVRMPLNKVKRKDVENSVLKESDKWLYDKLLERLDAHGDNPEKAFAEPIYKNDKKIDKNGKKLSPVSTVKVYSTQPSGFYINNGKAFVNNGSMVRLDVYQKPNKKGKIEHFFVPVYAHQVGKNKPTPTKILPAPKGFTDIDETFTKICSLYPNDYVRCHFGNEIREGYYASFNINNGAMQVMPHDAANKSNDSLIQISPRSANLIERYDIAILGDNYRWL

SEQ ID NO: 8311 - protein, 1139 aa, unidentified
  REGION 1..1139: note = Description of Unknown:uncultivated organism sequence
MELSKYSLGLDIGTTSVGWAVIDLEKERIHDLGVRIFERPEDPQNGDSLAKPRRVARSARHRLKRRRQRLNYLKRFFVNEKILTQAQIAEILDPKSAYNKLDIYALRDKALNHELTAGELFKVLYQISKRRGFKSNRKVVEETDSEGGRVSKALTINEQLLAEKGYKTVGQALAQDKKYTEHKRNKRDSYTNSFARADFIHELEEIIKAQRKYVLNNVSDEVLHSLIYGVDSDGLLTNRSAIMYQRPFMTEELIKKMVGECTFEKGEKRAPRASYSFELFRFANDLTHLVFIPKSTNKHQVKREQLQLTLNPEQIAAVVAEAKKTAKITYKKVRQVAGISEEYAPEYVRGKINKDDPYGDKNEFGKLKAYHDIKKALKSAPGDWMKVDNESTLNEIAYILTTEREDVEILKKLSGLALSDEATYAILKINPKNFRSFGHLSIKALQKITPHILSGLTYDKTCEKAGYDFRRKSANLEQITNPVVKRAISQTNKVVQAVIRKYGKPYFIKVETARDLAKNFKDRKAIENENKDNQAFNSEIKEIIEHGYNIKPKTKRGKNLLEFLRENNVPLSQNIDANGQMITKVKLYREQNGKCLYSGDPIDFQAMIHDDNAYQVDHIVPFSRSNNDGLTNKVLVKTEENQEKANCTPFEYFGGDEARWKQFAARVNATYQTRDVKTSDKAMNSENYKFNGYAMRKKQNLLIEEYKNDSWNARALNDTRYITRFVQNYLRQTVDFAEGDDKQRVFAPNGTITSYLRKRWGLNKVREENVLHHAADAAIVAAIDQHVIYRANLYAKRGEIIGFLAAAKTMNEKTNKLTGEILDDDEFTKAQRRKDALQVLSDKHFPEPWSGFRDEVDLRTRNINRESLHEKLQGAHLYDGNFLSEIEPIFVSRMPRRKATAQAHKETIRSPKAKDNDQRTVRMPLNKVKLKDVENSVLKESDAWLYNKLISLLETNDDNPEKAFAEPVYKNDKKFDKHGKPLMPVSTIKVYSTQPSGFLINKDRAFVNNGSMIRLDVYQKQNQKGKIEHFFVPVYAHQVGKNQPTPTKILPAPKGFTDIDDTFMKVCSLYSNDYVRCRFKNKIVEGYYVKYGSASGQMILLPHAAARKDDDTFVTCSARSATLIERYDISILGDNAPRS

SEQ ID NO: 8312 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKRFFRDNNLLTKEQIEELLKPENKLDPYKIREKALNEKISNDELFVGLYHIAKRRGYKSNRKSAEENDKENSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSFEKSEFRAPKASYSFEMFRLAENLAHLRVVINNEERNLTEEEISKVIEKAKDIKVLKYQHIREVLGYKKDENFSFPVNMIRGEIKKDSKNNGEENKFGELSFYHKVKAALSNTPEDWQKVCDNNYRMLDEFGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKEREKIKKTQKANASYNESIKERLQNEFNVPSPTGLQITKFKLYEQQNGKCVYSGKSLVLENLFSNEHYAEIDHVIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRLGKGSINKETIRSPKIVEGYVDSKGKPAIARKQRVRLTSVDLKTLYDSPVRETDPALYKILKARLDEFDNKPEKAFGDPSNPVYKPTKNGSLGNIVRSIKVYDTQNSKSGFLINEGKAFVNNGDTIRLDVFKRKNYKGEFEYYFSPIYAHLLNTKKVEILPTPNGRSAAEKADFNKIRDENGKIFAAEENGFVKQFSLYPNDYVRIYAGNKIVEGYYVGYDIDSGRVSLIGHDKADKKNTDRISGGTITFIERYDISILGDNYRWI

SEQ ID NO: 8313 - protein, 1119 aa, unidentified
  REGION 1..1119: note = Description of Unknown:uncultivated organism sequence
MTEKSSYSPKKYSLGLDIGTSSIGWAVLDLDKERIHDLGVRIFERPEDPQNGDSLAKPRRDARSARRRLKRRRQRLNHLKQFFIDQNILTKDQVEEVLDYRSDFNKLDVYELRAKALTEELSPEELLKVLYQIAKRRGFKSNRKVIEESDKEGGRVTSALKANEKFLADNNYTTVGDALSRDEKFAPHKRNKRDDYTNSFARDDFLRELEFIIKNQRKYALKNIPEQAINELIYGIDDGQATNVSAIMYQRPFMTRELIEKMVGNCTFEKDEKRAPKASYSFEMFRLASDLSHLVFIHRDASKRQAKRENLEVRLSPEQISKVIDAAKSQKSLTYKKVRSTAGISEDYVPKDVRGKKKEGDEFGEDNTFGGLKAYSDIRLALKDLPEDWAKIDNESAINQIAYVLTTQKADEGIRAELDSLPLSDKAKEAIIKIKPTNFKAFGHLSIKALQNITPYILEGMTYDKACEAAGYDFKKQSASLEQITNPVVKRAITQTLKVVRAIERKYGKPYFIKVETARDLAKNFKDRKAIENENKENQARNQSIIQTLNENGVVTPTGQQIIKVKLYREQNGVCLYSGKSIDFETMLRDDNAYQVDHIVPFSRSNNDGMTNKVLVLTEENQKKSNQTPFEYFGADEKRWKEFAARVESTYKTRDTKTADKAINAINYKYNGYAIKKKQNLLLQEYKNDSWNVRALNDTRYITRFIQNYLRQDVDFAEGEEKQRVIAPNGTTTAYLRKRWGLAKDRNEDVLHHAKDAAVVAAVDQNIVRQANLFAKRSEIATLLAAAKTMEEKTDKLTGEIIDEDEFDKAQRRKDAAIVLSSKYFPQPWNNFGKEVMKRTLNTDIATPQNELRGLDNYDEDFRLSVKPIFVSRMPRRKAAAQAHKETIRSPKVKDNDQRTVRMPLNKVKRKDVENSVLKESDKWLYDKLLERLDAHGDNPEKAFAEPIYKNDKKIDKNGKKLSPVSTVKVYSTQPSGFYINNGKAFVNNGSMVRLDVYQKPNKKGKIEHFFVPVYAHQVGKNKPTPTKILPAPKGFTDIDETFTKICSLYPNDYVRCHFGNEIREGYYASFNINNGAMQVMPHDAANKSNDSLIQISPRSANLIERYDIAILGDNYRWL

SEQ ID NO: 8314 - protein, 1103 aa, unidentified
  REGION 1..1103: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKKFFRDNNLLTKEQIEELLRPENKLNPYKIREKALNEKISNEELFISLYHIAKRRGYKSNRKSAEEKDKEGSKVLSAISKNEKLLKEYKTVASALNSNEKFIAHKRNKAEDYSNSFVRANFEDEAKLILKTQKEFGLNLSDEKINFLLFGNEKEGNFNGIFSQRPFMTSELIMKMRGKCSLEKSELRAPKASYSFEMFRLAENLAHLRVVINNEERSLTEEEISKVIEKAKDIKVLKYQHIREVLGYKKDENFSFPANMIRGEIKKDSKNNGEENKFGELSFYHKVKTALSNTPEDWQKVCDDNYRMLDELGEILSCNKDDESLRKEISKLGLSEKAVEVLMTINVSGFGHLSFKALRKIFPFLLKGDIYSDALKNAGYDVKQQLSGDKNKLPPLSKEDSAQITNPVVKRAVSQTIKVVNAIIREYGAPYQIKIEAASDLAKNFKERKKIKKAQDENASYNERIKERLQNEFNVPSPTGLQITKFKLYEQQNGKCAYSGKRLVLENLFSNEHYAEIDHIIPFSRCGNDSLINKVLVLTEENRQKGNLTPFEAWGADESRWAEYEARVNSMNLPFRKKGRLLAKVPPKEDWNSRALNDTRYISKFLGRYLRKNLKFAKFDNENPAQRVIVPNGSITSYLRRVWRVGSKNREENNLHHATDACVIAAIDQNVIQKISRLNKYFELFKYSAEDEVVDKITGEISSRADFEQTFEDIEPWKDFGKEVRKRTAHYESPIELHNELIGLENYDEDFRNRTTPIFVSRMPKRSGKGNINKETIRSPKIVEGYVDSKEKPVIARKQRIRLTSVDLKTLYDSPVRETDPVLYEILKVRLNEFGDKPEKAFGDPSNPVYKPTKNGSQGNIVRSIKVYDTLNSKSGFLINKGKAFVNNGDTIRLDVFKRKNYKGEFEYYFSPIYVHLLNAKKVEILPTPNGRSAAEKADFNKIRDENGKIFATEENGFVKQFSLYPNDYVRIYAGNRIVEGYYVKYGITDGTLNLMNHDQTSKDNLSLKHIGRGTITFIERYDISVLGDNYRWI

SEQ ID NO: 8315 - protein, 1258 aa, unidentified
  REGION 1..1258: note = Description of Unknown:uncultivated organism sequence
MDDGIKYSLGLDIGTTSVGWAVVNLDKERIEDLGVRIFERPENPKNGKSLAEPRRTARSTRRRLRRRRQRLNYLKQFFINQGLLTKQEVDDIIGSAHTKAWHQAHDPYQLRVKGLTEKLSPDELLIALYHIAKRRGYKSNRKSIEQSDTAGDGKKVNSAISKNDQILSEMKYSSVSQALLTDNRFRERKRNTIDDYRYSFSRVDFLDEIRHILDRQKDFYPNELSIDHINQLLGIDVYHDENGQPIPIDHKLTNNDINRLTKHGQTTLNGIFYQRPFMTSELINRMRGKCPLEKDQPRALKASYSFELFRLAEDLSHLQYTLDFVETGTDWQVRKERKRQAQFLTADQIKACVDKCLKTQTVKYSAIREVLGFKDDNSFQFTYIRGKSPDEKTLAKDPLAKEKNTFAQLRFYHGVKSVLKDLPNDWQDVSNDQDLFDKIGEVLTCNKDDYSIREGLIEVNKDRSAQGETELSEKAINAIVNSKLSFAGFGHLSLVALRKITPYLLKGNGMTYDKAVEKAGYQFNAKLSGHKNLLPPLSKEESHQITNPVVKRAVSQTIKVVNAIIHKYGAPYRIGIECAGELAKSFKEREDIKKRQDKNAENNQEAVKELRSGKLVSDGEQFEAQIAPTGTSITKLNFYKQQDCKCPYCGEPINLSKIFSDDNYAEIDHIIPFSICGNDTKANKVLVHTTCNQIKGNQTPYQTWGNDPERWKIIEATARANHKLGAAKQRRLLAQTLPDEDWSLHAINDTRYISKFISRYIKSNLKFRPMDDTDDDGHTQRQRVIMPAGAITSYLRRMWHIGHKDREEDCLHHSVDAVIVALTTQAIIQDCSVYSAYIDDHTKMQFGDNASQAGSAKLVRALQRITDPATGEIKEADYKELMQDMLPWPRFDEELRKREEQPDPVNDNLAIWRNKFSDLYKDQDSDFINRIHPIFVSRMPKRQGTGAANKETVRSNKTKDDDGKTRSAKVKLRDLTLKQLSNSAISSNEGVYEQIKQYIIDRDKWKDEIKAWRKAKKASKQTSNTDEANDDKNEPSAPTEPQEPKVYKSNRRFDRNGNPISPIKSIKVYDPHPMTSGFLVNNDTAYVNNGSMVRLDVYKRPNKRGKIEHFFVPVYAHMIKKGHPEIKPTKILPEPKKGTPKEIDSSFSFVCSLFPNDYVKVTLGSEVKEGYYVAYDITNCKIKLLPHAGTSKDLPTKGKDKSNSDQSDQSADETNDNDKKKTGVKHPNRYPAFRIAPRSATKIERLDINVLGDNYKWD

SEQ ID NO: 8316 - protein, 1118 aa, unidentified
  REGION 1..1118: note = Description of Unknown:uncultivated organism sequence
MTQKYSYSPKKYSLGLDIGTSSIGWAVLDLDKERIHDLGVRIFERPEVPKTGKSLAEPRRIDRSNRHRLRRRRQRLNYLKRFFIDNNLISESRISDMLSPTHPKKWRPIYDPYALRIKGLNERLSPEELFVALYHIAKRRGYKSNRISVEEQDIEGSQVLSAISENKLLLEKYKTKSVAKVLTLDEKFKNNKRNKISTYKNSFVRKNFEDEVMLLLDSQKKFGLKLPYEKIQTLLYGDIKNGNYNGIFSQRPFMTSELIKKMRGYCEFEPEKPRAPKASYSFELFRLAQNLSHLRIVVNRETRQLSEDEIAKIIEKAKNVKVLKYEHIRDILGYTDDQSFSFAQGMIRGKIKNDDKKNGEGNKFDSMIFYHTVKKALEQHPKDWDILAANNFELLDTAGLMLTVNKDDSSLRTELSKLNISTYAVEALLPINVSGFVHLSFDSLHRITPWLLRGLNYSEAVEKAGYSFSQSLSGNKKKLPPLSEKQAAQITNPVVKRAVSQTIKVVNAIIRKYGMPYSVKIETASELAKNAQERNKIKNIQDENAEYNEKIKQKLITEFNIPTPTGLQITKFKLREQQNGVSLYSGKEINLENLFADEHYGEIDHIIPFSRCGNDGLNNKVLVFADENQEKGNLTPYEAWGGDDKKWTQFEARVRATAGLPAAKRDRLLSKSKPAEDWNVRALNDTRYISRFLRQYIRDNLDFPKIEGKTGAQRVFSPSGPITSYLRRVWHVGNKNRDDNNLHHAADACIIAATSPSIIQKISSLNKYYELFKYTDKNEIVDKLTGEVLDRNQFEQHIADLEPWDDFGKEVRKRSKLYNTPSELHNELTGLKNYDEEFRLSTLPIFVSRMPKRSGKGSANDATFRSPKIVAGYIDEKGKPAIARKHRVSLHSVDLKKLYDSPIRETDPKLYKILEQRLKDFNGDPKKAFAESVYKPAKDGKRGNIVRSIKIYNTRDSRSGFLVNKQRAFVNNGKTIRLDVYKRKNYKDIYEYYFAPVYTHLINTQRIEVLPTPTGRSKNEKADFDTIRTEDNKIYATLENGFIKQFSIYPNDYVRIYFDNEIVEGYYVKYNTNDSSLKLIKHSDTSKNDSDLISKVAKTATLIERYDIAVLGDNYRWL

SEQ ID NO: 8317 - protein, 1118 aa, unidentified
  REGION 1..1118: note = Description of Unknown:uncultivated organism sequence
MAQKSSYSPKKYSLGLDIGTSSIGWAVLDLDKERIHDLGVRIFERPEVPKTGKSLAEPRRIARSARHRLRRRRQRLNYFKRFFIDNSLIPESRISDMLSPTHPKKWRPAYDPYDLRIKGLREKLSLEELFVALYHIAKRRGYKSNRISVEKQDVEGSQVLSAISENKLLLEKYKTKSVAKVLTLDEKFKNNKRNKTSTYKNSFVRKNFEDEVILLLESQKKFGLKLPYEKMQTLLYGDVKNGNYNGIFSQRPFMTKGLIEKMRGNCEFEPEKPRAPKASYSFELFRLAQNLSHLRIVVDQETRQLSEDEIAKIIEKAKNVKVLKYEHIRDILGYKGDQSFSFAQGMIRGKIKNDDKKNGEGNKFDSMIFYHTVKKNLEQYTKDWNILAADNFELLDNAGLILTVNKDDSSLRAELSKLDISTDAIEALLPINVSGFVHLSFNSLHRITPWLLRGLNYSEAVEKAGYSFFQSLSGNKKKLPPLSKKQANQITNPVVKRAVSQTIKVVNAVIGKYGLPCSVKVEAASELAKNAQERDKIKKIQDENAEYNEKIKQKLINEFNIPTPTGLQITKFKLREQQNGVSLYSGTEINLENLFTDEHYGEIDHIIPFSRCGNDGLNNKVLVFTDENQEKGNLTPYEAWGGDDKKWTQFEARVRATAGLPAAKRDRLLSKSKPVEDWNVRALNDTRYISRFLRQYIRDNLDFPKIEGKTGAQRVFSPSGPITSYLRRVWRVGNKNRDDNNLHHAADACIIAATDPGIIQKVSSLNKYYELFRYSDKNEVIDKLTGEVLNRNQFEQHIADLEPWHDFGKEVRKRSKLYDTPSELHNELTGLKNYDEEFRLSTLPIFVSRMPKRSGKGSTNSETFRSPKIVEGYLDEKGKPAIARKQRVPLHSVDLKKLYDSPIRETDPKLYKILEQRLKDFNGDPAKAFVESVYKPTKDSKRGNIVRSIKIYNTRDSRSGFLVNEQRAFVNNGKTVRLDVYKRKNYKDIYEYYFAPVYTHLINAQKIEVLPTPTGRSKNEKADFDTIRTEDDKIYATLENGFIKQFSIYPNDYVRIYFGNEIVEGYYVKYNTNDGSLKLIKHSETSKNDNNLISKSAKTATLIERYDISALGDNYRWL

SEQ ID NO: 8318 - protein, 1118 aa, unidentified
  REGION 1..1118: note = Description of Unknown:uncultivated organism sequence
MAQKSSYSPKKYSLGLDIGTSSVGWAVLDLDKERIHDLGVRIFERPEVPKTGKSLAEPRRIARSARHRLRRRRQRLNYLKRFFIDNNLISESRISDILSPTHPKKWRPIYDPYTLRIKGLNEKLSPEELFVALYHIAKRRGYKSNRISIEEQDVEGSQVLSAISENKLLLEKYKTKSVAKVLTLDEKFKNNKRNKTSTYKNSFVRKNFEDEVMLLLESQKKFGLKLPYEKIQTLLYGNVKNGNYNGIFSQRPFMTRELIEKMRGNCEFEPEKPRAPKASYSFELFRLAQNLSHLRIVVDQETRQLSEDEIAKIIEKAKNVKVLKYEHIRDILGYKGDQSFSFAQGMIRGKIKKDDKKNGEGNKFDSMIFYHTVKKNLEQYPKDWNILAANNFELLDNAGLILTVNKDDSSLRAELSKLDISTDAIEALLPINVSGFVHLSFNSLHRITPWLLRGLNYSEAVEKAGYSFSQSLSGDKKKLPPLSKKQANQITNPVVKRAVSQTIKVVNAVIGKYGLPCSVKIEAASELAKNAQERDKIKKIQDENATYNEKIKQKLIDEFNIPTPTGLQITKFKLREQQNGVSLYSGKEIKLENLFADEHYGEIDHIIPFSRCGNDGLNNKVLVFADENQEKGNLTPYETWGGDNQKWIQFEARVRATAGLPAAKRDRLLSKSNPVEDWNVRALNDTRYISRFLRQYIRDNLDFPKIEGKTGTQRVFSPSGPITSYLRRVWRVGNKNRDDNNLHHATDACIIAATDPGIIQKVSSLNKYYELFKYSDKNEVIDKLTGEVLNRNQFEQHIADLEPWDDFGKEVRKRSELYNTPSELHNELTGLKNYDEEFRLSTLPIFVSRMPKRSGKGSTNSETFRSPKIVEGYLDEKGRPAIARKQRVPLRSVDLKKLYDSPIRETDPKLYKILEQRLKDFNDNPVKAFAENIYKPTKDSKCGNIVRSIKIYNTRDSKSGFLVNEQRAFVNNGKTIRLDVYKRKNYKGIYEYYFTPVYTHLINTQKIEVLPTPTGRSKKEKADFDTIRTDDGEIYATLKNGFIKQFSIYPNDYVRIYFGNEIVEGYYVKYNTNDGSLKLIKHSETSKNDNDLISKSAKTATLIERYDISVLGDNYRWL

SEQ ID NO: 8319 - protein, 1131 aa, unidentified
  REGION 1..1131: note = Description of Unknown:uncultivated organism sequence
MTEKSSYSPKKYSLGLDIGTSSIGWAVLDLDKERIHDLGVRIFERPEDPQNGDSLAKPRRDARSARRRLKRRRQRLNHLKRFFVSQNILTKDRVEKVLNCTSDFNKLDVYDLRAKALAEELSPEELLKVLYQIAKRRGFKSNRKVVEESDKEGGRVTSALKANEKFLADNSYTTVGDALSRDEKFALHKRNKRDDYTNSFARDDFLHELKFIIKTQQNYTLKNVPEQAIKELICGIDDGQVTNVSAIMYQRPFMTKELIEKMVGDCTFEKNEKRAPKASYSFEVFRLASDLSHLVFIPRDAGKRQAKRENLEVRLSPEQISKVIDLAKNQKSLTYKKVRSTAGISEDYIPKDVRGKKKEGDEFGEDNTFGSLKAYSDIRSALKELPEDWAKIDNESAINQIAYILTTQKADEGIRAELNTLPLSDKAKEAIVKIKPTNFKAFGHLSIKALQKITPHILEGMTYDKACEAAGYDFKKQSASLEQITNPVVKRAITQTLKVVRAIERKYGKPYFIKVETARDLAKNFKDRKAIENENKENQARNQSIIQTLNENGIVTPTGQQVIKVKLYREQNGVCLYSGKPIDFETMLHDDNAYQVDHIVPFSRSNNDGMTNKVLVLTEENQKKGNQTPFEYFGADEKRWKEFVARVESIYKTRDIKTSDKATNAINYKYNGYAMKKKQNLLLQDYKNDSWNVRALNDTRYITRFIQNYLRQNVDFAEGEEKQRVIVPNGTTTAYLRKRWGLAKDRAEDVLHHAKDAAVVAAIDQKIVMQANLYAKHHEIKALLAATKTMEEKTDKLTGEITDEDEFDKAQRRKAAILVLSSKHFPQPWDNFGKEVMKRTLNTDIATLQNELRGLDNYDEDFRLSVKPIFVSREIRHKIRGEAHESKLRSNRNRNGQNIIRIPLTELTLQRLENSLVKEEFDSQKNSNGSSLYEKLLARLNECNGDSKKAFNPPFKLYKGPKQDKNGNPISPVAAVKVYDKKGVVSVGRKANAPVALAEMVRIRVYKKDNQIYMIPDYRINILENKETMELLKPLKKVSKIDNSFNFIGYLYKGDLITIQKDSQTFVGYFVQFEGDNRITIKNHLAVDSSRDSKSTVKRESLSGINYLKIHKVDVLGDVNFSEGIVWPGAS

SEQ ID NO: 8320 - protein, 1131 aa, unidentified
  REGION 1..1131: note = Description of Unknown:uncultivated organism sequence
MAEKSSYSPKKYSLGLDIGTSSVGWAVLDLDKERIHDLGVRIFERPEDPQNGDSLAKPRRDARSARHRLKRRRQRLNHLKQFFVDQNILTKNQVEEVLDYKSDFNKLDVYGLRSKALTEELLPEELLKVLYQIAKRRGFKSNRKVVEESDKEGGRVTSALKTNEKFIADNNYTTVGEALSRDKKFASHKRNKRDDYINSFARDDFLHELEAIIKTQRNYALKNVPEQAINELIYGIDDGQVTNVSAIMYQRPFITKELIEKMVGDCTFEKNEKRAPKASYSFEVFRLASDLSHLVFIPRDASKRQAKRENLEVRLSSEQISKVIDLAKNQKSLTYKKVRSTTGISEDYVPKDVRGKKKEGDEFGEDNIFSGLKAYNDIRLAMKDLPEDWAKIDNESVINQIAYILTTQKADEGIRAELDSLPLSDKAKEAIIKIKPTNFKAFGHLSIKALRKITPHILEGVTYDKACEAAGYDFKKQSASLEQITNPVVKRAITQTLKVVRAIERKYGKPYFIKVETARDLAKNFKDRKAIENDNKENQARNQSIIQTLNENGVVTPTGQQIIKVKLYREQNGVCLYSGKPIDFETMLRDDNAYQVDHIVPFSRSNNDGITNKVLVLTEENQKKGNQTPFEYFGVDEKRWKEYVARIESTYKTRDIKTSDKATNAINYKYNGYAMKKKQNLLLQDYKNDSWNVRALNDTRYITRFIQNYLRQNVDFAEGEEKQRVIAPNGTTTAYLRKRWGLAKDRAEDVLHHAKDAAVVAAIDNSIVRQANLFAKRGEIAALLSAVKTMEEKTDKLTGEIIDEDEFDKAQRRKDAAIVLSSKYFPQPWDNFDKEVMKRTLNTDVTTLQNELRGLNNYDEDFRLSVKPIFVSREIRHKIRGEAHESKLRSNRSRNGQNLIRIPLTELSLKRLENSLAKEEFDSQKNKNGSSLYEKLLTRLNECSGDAKKAFNPPFKLYKGPKQDKNGNPISPVAAVKVYDKKGVVSVGRKANAPVALAGMVRIRVYKKDNQIYMIPDYRINILENKETMELLKPLKKVSKIDNSFNFIGYLYKGDLITIQKDSQTFVGYFVQFEGDNRITIKSHLAADSSRSSKSTVKRESLSGINYLKIHKVDVLGDVNFSEGIVWPGAS

SEQ ID NO: 8321 - protein, 1167 aa, unidentified
  REGION 1..1167: note = Description of Unknown:uncultivated organism sequence
MAQKSSYSPKKYSLGLDIGTNSIGWAVLDLEKERIHDLGVRIFSGQIENRKRRQFSSAQRINKRKKQRLKHLKTVFINNGLLSSDEINLALKDQEITENIYSLRAKAATQQISHRELFRVLYLIAKKRGFKSNRKSDPNDSDSSDTKFKKQLAKNSATAEKYQTIGLMLENDPIYANQKHNSKDNYIATFQREDIRKEVEIILNKQFEKELNAPQTSDKYRNIIEVILDETTVDDNGEKQYLGMFTQRPYTNASLIEKMTGFCEFEKTERRYVKASYTTEEYVFLSNLSNIVILDTNNNDERYYIGKDDIGRLLALAKQEKNIKCSDVRKVLSLDKSICFSSRAIEDTYRDSIKHANKKCSAPQNKEKLAEALETARKIRDRSRKSIERQKVCEKGLETFSIFKRLFKDSVLEQKIDENPYLLDDIAYILTVNIDDESIKTNLQQLEFLSDHDISVIMNMSTDDLRHFSGRSNLSHLAMQNIIKYLKEGYQSHLAIQKAGYDTKEIYQGNNITLPPLKLSDFSQDGDETFEKYGINSKVTQRALSQSIKLINAIIKKYGSPTYVRVELAREFAKTEEEREKIERNNKRNREKNREYEEIINQIFRDNHKLPPSKIGHIIRKLTLRDQQDCKDIYSGDDIDITTLVLDESAYEIDHIIPRSKRFINDMNNLVLTSTKNNREKSNRLPLSYISDPTKQKDFLGRVNLIKDKQKQKNLRLDSCEDQDNMTERALNDTKHIARFFKNYIQRNLLFAGDDEEDGRQRVFAIPGPVTAYLRARWGFEQKDRDANALHHAIDACVIVATTPKLLNRVMYHESHREQGKLYSERQSAEQDTGDFGMQAYLRAKKMYHDSIDNVSGEIIDPHKHNVAYEIMQEHEKLYRYSFPRPWIDFAREVSLRASDIDKKTLQNKLVEINNYDAEFRKTLHPIFISHMRYGKTRGSGHGEQIYKKPYKGDNRIVQHKSIYEISPEDIENSPIIVSDRKLYELLKHAFQSVELKKNQKDKDRRIDESVIIRKPSKNPDKSPIVKRIPVYMSDKPIPHDIRGGAALNGKGTVAYSILCQHTTTNHYKVVPVYFRQIHANKKTELGEGWKYISRIVPNDFVVIIKKDGSKISGYYKTRKGDTLISILPHQHSDSSKAVSQRIGTAKEIHIYNISALGDNAPEEEYK

SEQ ID NO: 8322 - protein, 822 aa, unidentified
  REGION 1..822: note = Description of Unknown:uncultivated organism sequence
MINNEERNLTEEEISKVIEKAKDIKVLKYQHIREVLGYKKDENFSFPVNMIRGEIKKDSKNNGEENKFGELSFYHKVKAALSNTPEDWQKVCDNNYRILDELGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKERKKIKKTQDENASYNESIKERLKNEFNVLSPTGLQITKFKLYEQQNWKCAYSGEDFVIENLFSNEHYAEIDHIIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRSGNGSINKETIRSPKIVEGYIDSKGKPAIARKQRVRLTSVDLKTLYDSPVRETDPALYEILKARLDEFDNKPEKAFGDPSNPVYKPTKNGSLGNIVRSIKVYDTQNSKSGFLINEGKAFVNNGDTIRLDVFKRKNYKGEFEYYFSPIYAHLLNAKKVEILPTPNGRSAAEKADFNKIRDENGKIFATEENGFVKQFSLYPNDYVRIYAKNKIVEGYYVKYNIANGSISLIGHDKADKKNIDGVSGGTITSIERYDISVLGDNYRWI

SEQ ID NO: 8323 - protein, 1167 aa, unidentified
  REGION 1..1167: note = Description of Unknown:uncultivated organism sequence
MAQKSSYSPKRYSLGLDIGTSSVGWAVLDLDKERIHDLGVRVFSGQIENKRRRQFSSAQRINKRKKQRLKHLKAVFINNGLLSSDEINLALKDQRVTENIYSLRAKAATQQISHRELFRVLYLIAKKRGFKSNRKSDPNDSDSSDTKFKKQLAKNSATAKKYQTIGLMLENDPVYANQKHNSKDNYIATFQREDIRKEVEIILNKQFEKELNAPQTSDKYRNIIEAILDETTVDDNGEKQYLGMFTQRPYTNASLIEKMTGFCEFEKTERRYVKASYTTEEYVFLSNLSNIVILDTKNNDERYYIGKDDIGRLLALAKQEKNIKCSDVRKVLSLDKSICFSSRAIEDTYRDSIKHANKKYSAPQNKEKLAEALETARKIRDRSRKSIERQKVCEKGLETFSIFKRLFKDSVLEQKIDENPYLLDDIAYILTVNIDDESIKTNLQQLEFLSDHDISVIMNMPTDDLRHFSGRSNLSHLAMQNIIKYLKEGYQSHLAIQKAGYDTKEIYQGNNITLPPLKLSDFSQDGDETFEKYGINSRVTQRALSQSIKLINAIIKKYGSPTYVRVELAREFAKTEEEREKIERNNKRNREKNRKYEEIINQIFKDNHKLPPSKIGHIIRKLTLRDQQNCKDIYSGDHIDVTTLVLDESAYEIDHIIPRSKRFINDMNNLVLTSTKNNREKSNQLPLAYISDPTKQKEFLERVNLIKDKQKRKNLRLDSCEDQDNMTERALNDTKHIARFFKNYIQRNLLFAGDDEENGRQRVFAIPGPVTAYLRARWGFDQKDRDANALHHAIDACVIVATMPKLLNRVMYHESHREQGKLYSERQSAEQDTGDFGMQAYLRAKKMYHDSIDNVSGEIIDPHKHNVAYKIMQEHEKRYRYSFPRPWTDFMREVSLRAGDIDKKTLQNKLVEINNYDDEFRRTLHPIFISHMRYGKTRGSGHGEQIYKKPYKDDSRIIQHKSIYEISPDDIESSPIATSDRKLYELLKDTFSKIELKGNQSEKNKRIDKNTVIYKPSKNPDRSPVVKRIPVYVDKTPIPHDVRGGAVLNEKGTVAYSILCQNSTTGHYKVAPVYFRQIHANKKTELGEGWKYISRIVPNDFVVIIKKDGSKISGYYKTRKGDTLISILPHQHSDSSKAVSQRIGTAKEIHIYNISALGDNAPEEEYK

SEQ ID NO: 8324 - protein, 1118 aa, unidentified
  REGION 1..1118: note = Description of Unknown:uncultivated organism sequence
MAQKSSYSPKKYSLGLDIGTSSIGWAVLDLDKERIHDLGVRIFERPEVPKTGKSLAEPRRIARSARHRLRRRRQRLNYFKRFFIDNSLIPESRISDMLSPTHPKKWRPAYDPYDLRIKGLREKLSLEELFVALYHIAKRRGYKSNRISVEKQDVEGSQVLSAISENKLLLEKYKTKSVAKVLTLDEKFKNNKRNKTSTYKNSFVRKNFEDEVILLLESQKKFGLKLPYEKMQTLLYGDVKNGNYNGIFSQRPFMTKELIEKMRGNCEFEPEKPRAPKASYSFELFRLAQNLSHLRIVVDQETRQLSEDEIAKIIEKAKNVKVLKYEHIRDILGYKGDQSFSFAQGMIRGKIKNDDKKNGEGNKFDSMIFYHTVKKNLEQYPKDWNILAADNFELLDNAGLILTVNKDDSSLRAELSKLDISTDAIEALLPINVSGFVHLSFNSLHRITPWLLRGLNYSEAVEKAGYSFFQSLSGNKKKLPPLSKKQANQITNPVVKRAVSQTIKVVNAVIGKYGLPCSVKVEAASELAKNAQERDKIKKIQDENAEYNEKIKQKLINEFNIPTPTGLQITKFKLREQQNGVSLYSGTEINLENLFTDEHYGEIDHIIPFSRCGNDGLNNKVLVFTDENQEKGNLTPYEAWGGDDKKWTQFEARVRATAGLPAAKRDRLLSKSKPVEDWNVRALNDTRYISRFLRQYIRDNLDFPKIEGKTGAQRVFSPSGPITSYLRRVWRVGNKNRDDNNLHHAADACIIAATDPGIIQKVSSLNKYYELFRYSDKNEVIDKLTGEVLNRNQFEQHIADLEPWHDFGKEVRKRSKLYDTPSELHNELTGLKNYDEEFRLSTLPIFVSRMPKRSGKGSTNSETFRSPKIVEGYLDEKGKPAIARKQRVPLHSVDLKKLYDSPIRETDPKLYKILEQRLKDFNGDPAKAFVESVYKPTKDSKRGNIVRSIKIYNTRDSRSGFLVNEQRAFVNNGKTVRLDVYKRKNYKDIYEYYFAPVYTHLINAQKIEVLPTPTGRSKNEKADFDTIRTEDDKIYATLENGFIKQFSIYPNDYVRIYFGNEIVEGYYVKYNTNDGSLKLIKHSETSKNDNNLISKSAKTATLIERYDISALGDNYRWL

SEQ ID NO: 8325 - protein, 1134 aa, unidentified
  REGION 1..1134: note = Description of Unknown:uncultivated organism sequence
MYHITGKGYNDVMKYSLGLDIGTSSVGWAVLDLEKERIHDLGVRIFERPEDPQNGDSLAKPRHDARSARRRLKRRRQRLNHLKQFFINQNILTKDQVEEVLDPESDYNKLDVYALRSKALTEELTPEELLKVIYQIAKRRGFKSNRKVVEESDKEDGRVTSALKTNEKFLTENSYATVGDALNHDEKFAPHKRNKRDNYTNSFARNDFLRELEAIIRTQRNCVLKDVSEQAINELVYGINDGQVTNVNAIMYQRPFMTKELIEKMVGDCTFEKGEKRAPKASYSFEIFRLASDLSHLVFIPRDTSKRQAKRENLEIKLSSEQIRKVIDAAKNQKSLTYKKVRSIAGISDDYVPKDVRGKKKDGDEFGEGNTFGGLKAYSDIRSALKDMPEDWAKIDNETMINQVAYILTTQKADQGIRTELNQLPLSDKAKEAIIQIKPTNFKAFGHLSIKALQKITPHILEGMTYDKACEAAGYDFKKQSVSLEQITNPVVKRAITQTLKVVRAIERKYGKPYFIKVETARDLAKNFKDRKAIENENKENQAHNQSIVQTLNENNIVTPTGQQIIKVKLYREQNGVCLYSGKPIDFETMLRDDNAYQIDHIVPFSRSNNDGMTNKVLVLTEENQKKSNKTPFEYFGTDDQRWKEYAARVEAIYKTCDVKTADKATNVVNYKYNGYAMRKKQNLLLQVYKNDSWNVRALNDTRYITRFIQNYLSQMVDFAEGEEKQRVVAPNGTTTAYLRKRWGLAKDRTDDVLHHAKDAAVVAAIDMRIVYQANLFSKEQEMEQYLVNANTIDKKRQILLQSTDKDTGEITDEDAFLKAQKDLAEAEYFKLRSDEETKNHFPQPWSDFSKEVMKRTLNTDIATLQNELRGLDNYDDEFRLSVKPIFVSRMPRRKATARAHKDTIRSPKAKDGDQRTVRMPLSKVKRKDVENSVLKESDQWLYDKLLERLDNHDDNPEKAFAEPIYKNDKKYDKNGKQLSPVSTIKVYSTQPSGFFINKGKAFVNNGSMVRLDVYRRSNKKGKIEHFFVPVYAHQVGKNKPAPTKILPAPKGFTDIDETFTKVCSLYPNDYVRCYFNNRVEEGYYVMYGIAVGQMVLLKHSAPGKSETKSISPRSATKIERLDINVLGDNYKWD

SEQ ID NO: 8326 - protein, 1131 aa, unidentified
  REGION 1..1131: note = Description of Unknown:uncultivated organism sequence
MNYSLGLDIGTTSCGWSVINLDKKRIEDLGVRIFEGAENPKNGQSLATPRREKRGMRKRLHRRRIRLDFLKQFFIQQKILSSQQIESLLAPHKNQIDPYTVREKALSEKLTPEELFVALYHISKRRGYKSNSRAESSGDADENKKTLSAITANQVFLKEYQTVGEALNHAEKFKSHKRNKPNDYSNSFARADFEDEIKKILNKQSEFYPVLNEEKIQELLYSENFGVLFQRRFMTPELIEKMRGKCQFEKEKPRAQRASYSFELFRLASDLVHLTYNMGNKLTIDEIASCIEKAKELSVLKYSHIQKILDEDMEDEINFDYVRGLKRKDLLKDEVEAKKKALEQKFGELKFYHAIKKALKDQPTEWAEIESNIELFDNIGFVLTANKEDDSVREELEKLGLKPQVIDSISNIKQSFSGFGHLSLEALRKITPFILQGETYDKAVVDAGYVFKAKLAGGLNRLPALSKEENNQITNPVVKRAISQSIKVVNAIILKYGAPTRLHIECASELAKSFNKRNDIIKIQDENRENNEKLVARLKEEFHILSPTALQITKFKLYEQQDGKCLYSGKPIDLNRLFSDEHYCEIDHIIPISHCGNDGMINKVLVLNQENQEKRNQTPFEAWGSDEKRWQSFVARVESNPKIFAKKRARLLAKTPPKEDWNVRALNDTRYITRFLANYFKQNLKFADHTEGKKVVYTPTGNITSYLRHVWHIGKKDRSKNLHHAVDAVITALVTDEVIRQCALMNKMIELGAKYRTKGINLANYQNGMLAATDPVTGEIVDLAKYEEVRESVLPWPNFDHEVRFRTTPLACFITEEKEDKKKTESGQLSEEAKTHLQNASINTLAEWRDQFREIYKDQDEEFRSSIHPIFVSRMPKRKGIGSLHDDTIRSPKGILIDEKTGVISANPNRSSFIRKRLQDVKIADLENSILKQSDKVLYQQLKNLLEANGDDPKKAFKEPVYKNNVKFDKNGHPLSPVTTIKVNDDKSVKSGISLNHGTQFVNNGSMVRLDVYQKDIKGEKKLFYVPIYTHQVRKGSNRILPTTCGYDFIDNTFAKLCSVYPNDYLIMKKGDEILQGYYIKYNVNNSAIAYTSNVKEGRSDFVTATGRALSELYRLDISVLGDNYHWERMY

SEQ ID NO: 8327 - protein, 1151 aa, unidentified
  REGION 1..1151: note = Description of Unknown:uncultivated organism sequence
MEYLIFFAYAWQSPNLWYNIIMKYSIGLDIGITSCGWSVINLDKKRIEDLGVRIFNAAEDPQKHISLALPRREKRSSRRRFHRRRARLNYLKEFFVELNLLDESKIIQLLTPHKGQLNPYILREKALKEKLSADELFIALYHIAKRRGYKSNRRAESSSDENENKKTLHAISENQKLLIDYQTVAKVLNQNEKFAAHKRNKPNDYSNSFARADFESEITTILNKQAEFYPELTEEKINDLLYRQNYGLFFQRPFMSPELIAKMRGNCQFEKDAPRAQKASVSFEIFRLASDLVHLTYNNGQKLTPEEVAMCIEKAKEVVTFKYSHIAKILNQTHPEEIIFDYVRGLKKKDLNSDTDEAKKKALNQKFSELKFYHAIKKALIDLPEEWQKLEKNLELFNEIGFILTANKEDESVIKHLEELNLSKQAIENIASIKQNFTGFCHLSLLALNKITPYILEGNTYDKAVVLAGYNFNNKLSGDKNRLPALTEEESQQITNPVTKRAVSQTIKVVNAIIRKYGAPTRIHIECASELAKSYDKRRQIEDNQKDNQATNQKIVDILKNEYHIVTPNYLQITKYKLYLEQDGKCLYSNQPIDLDRLFTDEHYCEIDHIIPKSRCGNDSLINKALVFNRENQEKRNQTPFEAWGGDTERWQQFKTNVQANLKIHPRKKLRLLAEVPPKEDWNSRALNDTRYITRFLSNYFKRHLKFSDDSHSKKKVFTPTGGITSYLRRIWHVGSKDRSGNLHHAVDATIIALVTEDIIKQCALMNKYIELGANYTTKGINLSKFHHDIHSVIDPVTGEVIDLAGYEKIKEEVLPWPNFDTELRFRATPLAIFVNELPKDKKEPKPELAESAKLQQKNKSINTLAEWRDQFREIYKDQDELFKNSIHPIFVSRMPKRKGTGSLHQDTVRSPKGIIVDPKTQKITVNPNRSSYIRTNLENIKLADLENSIIKTDDESLYQQLKQLLEENDNNPKKAFKEPVYKNNIKVDKNGKPLSPVRTIKLIDDKNVKSGILLSRGTQFVNNGSMVRVDIYQKKVKGKNQLFYVPIYAHQVKKGSTRILPTTCGYDYVDETFKKLFSLYPNDYIIMKKDNNTIQGYYIKYNTSNSVITHISNLMPGSTNFKETTGRSLTEIYRLDISILGDNYPWEKLY

SEQ ID NO: 8328 - protein, 959 aa, unidentified
  REGION 1..959: note = Description of Unknown:uncultivated organism sequence
MRYSLGLDIGTTSVGWAVINEDRNRIEDLGVRIFERPENPKNGESLAKPRRDSRSTRRRLKRRRQRLNNLKHFFINQQLLTNEEIQDLLNPSKTAEQKAQFDPYQLREKAINSQVSPTELFVALYHIAKRRGYKSNRKKVEENSKEESGRVLMAIKQNKALLDNYRSVAIALLRDDKFKLHKRNKLDSYTNSFIREDFEKEMLAILNAQQWPDSWIEELLYSKPNGLFFQRPFMTSELIEKMRGKCPLEGTPRAQKASFSFELFRLAQDLAHLTYNDGNKLSEDQINRVVEKAKTTAKVTYKAVKEAIGFKSDPNFRFDYIRGKQTEYTEMEKREFCNLRFYHAIKKACTEIDWDRISQDLDTFDQIGYILTAYKDDESVEAELLKLNLQPETINQLESLSFSGFCGHSLTALQKLTPHLLSSKTYNQAVELEYPGQFNEKLSGENNELPSLTEAQLCQLTNPVVKRAISQTRKVINAVIHKYGAPTQIKIECANDLAKNFKERHDIKKAQDENANYNEKIIEKLKELGITTPTGTQITKYKLREQQLAKCAYCGANLTEDTLLDDRLTEIDHIIPFSRSGNDSNNNKVLVCPTCNQEKLNRTPFEKWGNDTERWLKIQALAESFNIPFAKKKRLLTEKLPKEEWGSHALNDTRYAMRFISQYIKSNLKFSDESSGKQKVLLPTGFITSYLRKMYHLGEKDRDLNNCHHAVDACIIATVSQAQIKKFAEYNKWKELGASYQTVIWYDEDGESHQKTKVEYAEMKAELLPWPRFDEEVKKRSGSTYDSSKIEKLSDFRDKFRDFDTYDETFLEKIHPLFVSRMPKRSTKGQAHKETIRSPKAEAGGRRLTRKRLSDCDLEDIKNSILPESDQALYQQLCNLYSENGKDAFKEPIYKNNQRIDKNGKAISPVKSIKVYSTEPHLASSLTMVLSSSTMATRSVSTFTNAKISSSQLQFTCTP

SEQ ID NO: 8329 - protein, 1103 aa, unidentified
  REGION 1..1103: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKKFFRDNNLLTKEQIEELLRPENKLNPYKIREKALNEKISNEELFISLYHIAKRRGYKSNRKSAEEKDKEGSKVLSAISKNEKLLKEYKTVASALNSNEKFIAHKRNKAEDYSNSFVRANFEDEAKLILKTQKEFGLNLSDEKINFLLFGNEKEGNFNGIFSQRPFMTSELIMKMRGKCSLEKSELRAPKASYSFEMFRLAENLAHLRVVINNEERSLTEEEISKVIEKAKDIKVLKYQHIREVLGYKKDENFSFPANMIRGEIKKDSKNNGEENKFGELSFYHKVKTALSNTPEDWQKVCDDNYRMLDELGEILSCNKDDESLRKEISKLGLSEKAVEVLMTINVSGFGHLSFKALRKIFPFLLKGDIYSDALKNAGYDVKQQLSGDKNKLPPLSKEDSAQITNPVVKRAVSQTIKVVNAIIREYGAPYQIKIEAASDLAKNFKERKKIKKAQDENASYNERIKERLQNEFNVPSPTGLQITKFKLYEQQNGKCAYSGKRLVLENLFSNEHYAEIDHIIPFSRCGNDSLINKVLVLTEENRQKGNLTPFEAWGADESRWAEYEVRVNSMNLPFRKKGRLLAKVPPKEDWNSRALNDTRYISKFLGRYLRKNLKFAKFDNENPAQRVIVPNGSITSYLRRVWRVGSKNREENNLHHATDACVIAAIDQNVIQKISRLNKYFELFKYSAEDEVIDKITGEISSRADFEQTFEDIEPWKDFGKEVRKRTAHYESPIELHNELIGLDNYDEEFRNKTTPIFVSRMPKRSGKGNINKETIRSPKIVEGYVDSKEKPVIARKQRIRLTSVDLKTLYDSPVRETDPALYEILKARLNEFGDKPEKAFGDPSNPVYKPTKNGSQGNIVRSIKVYDTLNSKSGFLINKGKAFVNNGDTIRLDVFKRKNYKGEFEYYFSPIYVHLLNAKKVEILPTPNGRSAAEKADFNKIRDEDGKIFATEENGFVKQFSLYPNDYVRIYAGNRIVEGYYVKYGITNGTLNLMNHDQTSKDNLSLKHIGCGTITFIERYDISVLGDNYRWI

SEQ ID NO: 8330 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSEARRTARSARRRLKRRRQRLNFIKRFFRDNNLLTKEQIEKLLKPENKLDPYKIREKALNEKISNEELFIGLYHIAKRRGYKSNQKSAEENDKEKSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSLEKSEFRAPKASYSFEMFRLAENLAHLRVVINNKERSLTEEEISKIIEKAKDIKVLKYQHVREVLGYKKDENFSFPANMIRGEIKKDSKNNGEENKFGELSFYHKVKAALSNTPEDWQKVCDNNYRMLDELGEILSCNKDDENLRKEISKLNLSEDAVEALMMINVSGFGHLSFKALRKILPFLLKGNIYSDALKNAGYDTKQQLSGDKNKLPPLSKGESAQITNPVVKRAVSQTIKVVNAIIREYGAPYQIKIEAAGDLAKNFKEREKIKKVQKANASYNESIKERLQNEFNVPLPTGLQITKFKLYEQQNGKCAYSGKRLVLENLFSNEHYAEIDHIIPFSRCGNDSLMNKVLVFTEENRQKGNLTPFEAWGANESQWADFEARINSMNLPFRKKERLLAKVPPKEDWNSRALNDTRYISKFLSRYLRKNLKFAKFENENPAQRVIVPNGSITSYLRRIWRVGSKDREENNLHHATDACIIAAIDQSAIQKISRLNKYFELFKYSVEDEVIDKITGEISSRTDFEQTFEDIEPWKDFGKEVRKRTAHYESPMELRNELIGLENYDEEFRNKTTPIFVSRMPKRSGKGSINKETIRSPKIVEEYIDSKGKPAVARKQRVRLTSVDLKTLYDSPVRETDPALYEILKARLNEFDNKPEKAFGDLSNPVYKPTKNGGRGNIVRSIKIYDTQNSKSGFLINKGKAFVNNGDTIRLDVFKRKNYKGEFEYYFSPIYAHLLNAKKVEILPTPNGRSAAEKADFNKIRDENGKIFATEENGFVKQFSLYPNDYARIYAENKIVEGYYVGYDIDSSRISLIGHDKADKKSTDRISGGMITLIERYDISVLGDNYRWI

SEQ ID NO: 8331 - protein, 1131 aa, unidentified
  REGION 1..1131: note = Description of Unknown:uncultivated organism sequence
MNYSLGLDIGTTSCGWSVINLDKKRIEDLGVRIFEGAENPKNGQSLATPRREKRGMRKRLHRRRIRLNFLKQFFIQQKILSSQQIESLLAPHKNQIDPYTVREKALSEKLTPEELFIALYHIAKRRGYKSNSRAESNGDADENKKTLSAITANQAFLKEYQTVGEALNHAEKFKSHKRNKPNDYSNSFARADFEDEIKKILNKQSEFYPVLNEEKIQELLYSENFGILFQRRFMTPELIEKMRGKCQFEKEKPRAQRASYSFELFRLASDLVHLTYNMGNKLTIDEIASCIEKAKELSVLKYSHIQKILSENTSYEINFDYIRGLKRKDLIKDEAEAKKKALEQKFGELKFYHAIKKALKDQPAEWKEIESNIELFDNIGFVLTANKEDDSVREELNKLGLKPSVIDGIYNIKQSFAGFGHLSLEALRKITPFILQGETYDKAVVDAGYIFTAKLSGNSNRLPALSKEENNQITNPVVKRAISQSIKVVNAITLKYGAPTRLHIECASELAKSFDKRNDIIKIQDENRENNEKLVARLKEEFHILSPTALQITKFKLYEQQDGKCLYSGSPIDLNRLFSDEHYCEIDHIIPISRCGNDGMINKVLVLNQENQEKRNQTPFEAWGSDEKRWQSFVARVESNPKIFAKKRARLLAKTPPKEDWNVRALNDTRYITRFLANYFKQNLKFADHTEGKKVVYTPTGNITSYLRHVWHIGKKDRSKNLHHAVDAVITALVTDEVIRQCALMNKMIELGAKYRTKGINLANYQNGMLAATDPVTGEIVDLAKYEEVRESVLPWPNFDHEVRFRTTPLACFITEDKEDKKKTESGQLSEEAKTHLQNASINTLAEWRDQFREIYKDQDEEFRSSIHPIFVSCMPKRKGIGSLHDDTIRSPKGILIDEKTGVISANPNRSSFIRKRLQDVKIADLENSILKQSDKVLYQQLKNLLEANGDDPKKAFKEPVYKNNVKFDKNGHPLSPVTTIKVNDDKSVKSGISLNHGTQFVNNGSMVRLDVYQKDIKGEKKLFYVPIYTHQVRKGSNRILPTTCGYDFIDNTFAKLCSVYPNDYLIMKKGDEILQGYYIKYNVNNSAIAYTSNVKEGRSDFVTATGRALSELYRLDISVLGDNYHWERMY

SEQ ID NO: 8332 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKKFFRDNNLLTKEQIEELLKPENKLNPYKIREKALDEKISNEELFISLYHIAKRRGYKSNRKSAEEKDKEGSKVLLAISKNEKLLKDYKTVASALNSNEKFIAHKRNKAEDYSNSFVRANFEDEAKLILKTQKEFGLNLSDEKINFLLFGNEKEGNFNGIFSQRPFMTSELIMKMRGKCSLEKSELRAPKAGYSFEMFRLAENLAHLRVVINNEERSLAEDEISKVIEKAKDIRVLKYQHIREVLGYKKDENFSFPANMIRGEIKKDSKNNGEENKFGELSFYHKVKTALSNTPEDWQKVCDNNYRMLDELGEILSCNKDDESLRKEISKLGLSEKAVEVLMTINVSGFGHLSFKALRKILPFLLKGDIYSDALKNAGYDVKQQLSGDKNKLPPLSKEDSAQITNPVVKRAVSQTIKVVNAIIREYGAPCQIKIEAASDLAKNFKERKKIKKAQDENASYNERIKERLQNEFNVPLPTGLQITKFKFYEQQNGKCAYSGKKLVLENLFSNEHYAEIDHIIPFSRCGNDSLMNKVLVLTEENRQKGNLTPFKAWGADKSRWAEYEARVNSMNLPFRKKERLLAKVPPKEDWNSRALNDTRYISKFLSQYLRKNLKFAKFDNENPVQRVIVPNGSITSYLRRVWRVGSKNREENNLHHATDACVIAAIDQNVIQKISRLNKYFELFKYSAEDEVIDKITGEISSRADFEQTFEDIEPWKDFGKEVRKRTAHYESPIELHNELIGLENYDEDFRNKTTPIFVSRMPKRSGKGNINKETIRSPKIVEGYVDSKEKPVIARKQRVRLTSVDLKTLYDSPVRETDPALYEILKARLNEFDNKPEKAFGDPSNPVYKPTKNGGQGNIVRSIKVYDTQNSKSGFLINKGKAFVNNGDTIRLDVFKRKNYKGEFEYYFSPIYVHLLNAKKVEILPTPNGRSSAEKADFNKIRDENGKIFATEENGFVKQFSLYPNDYVRIYTKNKIVEGYYVKYNIANGSIYLIGHDKADKKNIDRVSGGTIASIERYDISVLGDNYRWI

SEQ ID NO: 8333 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSEARRTARSARRRLKRRRQRLNFIKRFFRDNNLLTKEQIEKLLKPENKLDPYKIREKALNEKISNEELFIGLYHIAKRRGYKSNQKSAEENDKEKSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSLEKSEFRAPKASYSFEMFRLAENLAHLRVVINNKERSLTEEEISKIIEKAKDIKVLKYQHVREVLGYKKDENFSFPANMIRGEIKKDSKNNGEENKFGELSFYHKVKAALSNTPEDWQKVCDNNYRMLDELGEILSCNKDDENLRKEISKLNLSEDAVEALMMINVSGFGHLSFKALRKILPFLLKGNIYSDALKNAGYDTKQQLSGDKNKLPPLSKGESAQITNPVVKRAVSQTIKVVNAIIREYGAPYQIKIEAAGDLAKNFKEREKIKKVQKANASYNESIKERLQNEFNVPLPTGLQITKFKLYEQQNGKCAYSGKRLVLENLFSNEHYAEIDHIIPFSRCGNDSLMNKVLVFTEENRQKGNLTPFEAWGANESRWADFEARINSMNLPFRKKERLLAKVPPKEDWNSRALNDTRYISKFLSRYLRKNLKFAKFENENPAQRVIVPNGSITSYLRRIWRVGSKDREENNLHHATDACIIAAIDQSAIQKISRLNKYFELFKYSVEDEVIDKITGEISSRTDFEQTFEDIEPWKDFGKEVRKRTAHYESPMELRNELIGLENYDEEFRNKTTPIFVSRMPKRSGKGSINKETIRSPKIVEEYIDSKGKPAVARKQRVRLTSVDLKTLYDSPVRETDPALYEILKARLNEFDNKPEKAFGDLSNPVYKPTKNGGRGNIVRSIKIYDTQNSKSGFLINKGKAFVNNGDTIRLDVFKRKNYKGEFEYYFSPIYAHLLNAKKVEILPTPNGRSAAEKADFNKIRDENGKIFATEENGFVKQFSLYPNDYARIYAENKIVESYYVGYDIDSSRISLIGHDKADKKSTNRISGGMITLIERYDISVLGDNYRWI

SEQ ID NO: 8334 - protein, 1153 aa, unidentified
  REGION 1..1153: note = Description of Unknown:uncultivated organism sequence
MKPSKYSLGLDIGTTSVGWAVIDLEKERIHDLGVRIFERPEDPQNGDSLAKPRRDARSARHRLKRRRQRLNYLKRFFVNEKILTQAQIAEILDPKSTYNKLDAYALRDKALNHKLTAEELFKVLYQISKRRGFKSNRKSVEETDREGGRVSKALTINEQLLAERGYKTVGQALAQDEKYTEHKRNKRDSYTNSFARADFIHELEEIIKSQRKYALNNVGDEALHSLIYGVDSDGLLTNSSAIMYQRPFMTEELIKKMVGECTFEKGEKRAPRASYSFEIFQFANNLVNLVFVPKNTNSRQAKREHFRLTLNPEQIAAVVTEAKKTASITYKKVRQVAGISEEYAPGYVRGKINKDDPYGEKNEFGKLKAYHDIKKALKSTPEDWVKVDNESTLNEIAYILTTEREDVEILKKLSGLALSDEATYAILKINPKNFRSFGHLSIKALQKITPHILSGLTYDKACEKAGYDFRRKSANLEQITNPVVKRAISQTNKIVQAVIRKYGKPYFIKVETARDLAKNFKDRKAIENENKDNQAFNSEIKEIIEHGYNIKPKTKRGKNLLEFLRENNVPLSQNIDANGQMITKVKLYREQNGKCLYSGDPIDFQAMIHDDNAYQIDHIVPFSRSNNDGLTNKVLVKTEENQEKANRTPFEYFGGDETRWKQFAARVNATYQTRDIKTSDKAINSENYKFNGYAMRKKQNLLIEEYKNDSWNTRALNDTRYITRFVQNYLRQTVSFAEGDDKQRVLAPNGTITSYLRKRWGLSKVREENVLHHAADAAIVAAIDNRIICQANLFSRDQELKLYTQTIKSIEEKKRILLKSTDQETGEITEEDQFSQAQREKAELEYIKQSMDENSKHRFPEPWADFAKEIRKRTLDTDTETLRNELYGLEGYDDEFRSQVRPIFVSRMPRRKAAAQAHKETIRSPRVKDNDQRTVRIPLSKIKIKDVENSVLKESDAWLYSKLISLLEANDNNPEKAFAEPVYKNDKKFDKHRKPLMPVSTIKVYSTQPSGFLVNKGRAFVNNGSMIRLDVYQKQNQKGRIEHFFVPVYAHQVGKNQSTPTKILPAPKGFADVDETFTKVCSLYPNDYVRCYFKNTIEEGYYLAYDSASGRITVLNHSAANKEGDNRVRISPRSATLIKRYDISILGDNAPRS

SEQ ID NO: 8335 - protein, 1131 aa, unidentified
  REGION 1..1131: note = Description of Unknown:uncultivated organism sequence
MAEKSSYSPKKYSLGLDIGTSSVGWAVLDLDKERIHDLGVRIFERPEDPQNGDSLAKPRRDARSARHRLKRRRQRLNHLKQFFVDQNILTKNQVEEVLDYKSDFNKLDVYGLRSKALTEELLPEELLKVLYQIAKRRGFKSNRKVVEESDKEGGRVTSALKTNEKFIADNNYTTVGEALSRDKKFASHKRNKRDDYINSFARDDFLHELEAIIKTQRNYALKNVPEQAINELIYGIDDGQVTNVSAIMYQRPFITKELIEKMVGDCTFEKNEKRAPKASYSFEVFRLASDLSHLVFIPRDASKRQAKRENLEVRLSSEQISKVIDLAKNQKSLTYKKVRSTTGISEDYVPKDVRGKKKEGDEFGEDNIFSGLKAYNDIRLAMKDLPEDWAKIDNESVINQIAYILTTQKADEGIRAELDSLPLSDKAKEAIIKIKPTNFKAFGHLSIKALRKITPHILEGVTYDKACEAAGYDFKKQSASLEQITNPVVKRAITQTLKVVRAIERKYGKPYFIKVETARDLAKNFKDRKAIENDNKENQARNQSIIQTLNENGVVTPTGQQIIKVKLYREQNGVCLYSGKPIDFETMLRDDNAYQVDHIVPFSRSNNDGITNKVLVLTEENQKKGNQTPFEYFGVDEKRWKEYVARIESTYKTRDIKTSDKATNAINYKYNGYAMKKKQNLLLQDYKNDSWNVRALNDTRYITRFIQNYLRQNVDFAEGEEKQRVIAPNGTTTAYLRKRWGLAKDRAEDVLHHAKDAAVVAAIDNSIVRQANLFAKRGEIAALLSAVKTMEEKTDKLTGEIIDEDEFDKAQRRKDAAIVLSSKYFPQPWDNFDKEVMKRTLNTDVTTLQNELRGLNNYDEDFRLSVKPIFVSREIRHKIRGEAHESKLRSNRSRNGQNLIRIPLTELSLKRLENSLAKEEFDSQKNKNGSSLYEKLLTRLNECSGDAKKAFNPPFKLYKGPKQDKNGNPISPVAAVKVYDKKGVVSVGRKANAPVALAGMVRIRVYKKDNQIYMIPDYRINILENKETMELLKPLKKVLKIDNSFNFIGYLYKGDLITIQKDSQTFVGYFVQFEGDNRITIKNHLAVDSSRDSKSTVKRESLSGINYLKIHKVDVLGDVNFSEGIVWPGAS

SEQ ID NO: 8336 - protein, 501 aa, unidentified
  REGION 1..501: note = Description of Unknown:uncultivated organism sequence
MNNLVLTSTKNNREKSNQLPLAYISDPTKQKEFLERVNLIKDKQKRKNLRLDSCEDQDNMTERALNDTKHIARFFKNYIQRNLLFAGDDEENGRQRVFAIPGPVTAYMRARWGFDQKDRDANALHHAIDACVIVATTPKLLNRVMYHESHREQGKLYSERQAAKQDTGDFGMQAYLQAKKMYYDSLDRVSGEIIDPHKHNVAYKIMQEHEKRYRYSFPRPWTDFMREVSLRAGDIDKKTLQNKLVEINNYDDGFRRTLHPIFISHMRYGKTRGSGHGEQIYKKPYKDDSRIIQHKSIYDISPDDIDNSPIAISDRKLYELLKDAFSKIELKVNQSEKDKRIDKNTVIYKPSKNPDKSPVVKRIPVYIDKTPIQHDVRGGAVLNEKGTVAYSILCQSSTTGHYKVVPVYFRQIHANENIELEEGWKYISRIVPNDFVVIIKKDGSKISGYYKTRKGDTLISILPHKHSDSSRAISQRIGTAKEIRIYNISVLGDNTPEEEYK

SEQ ID NO: 8337 - protein, 1145 aa, unidentified
  REGION 1..1145: note = Description of Unknown:uncultivated organism sequence
MTQKYSYSPKKYSLGLDIGTSSIGWAVLDLDKERIHDLGVRIFEKPEHPKSGDSLAKPRRDARSARRRLKRRRQRLNNLKQFFISQNILTRDRIEEVLSDKSEFNKLDVYALRSKALTEKLSPEELFKVMYQIAKRRGFKSNRKVEEESEKEGGRVSKALKTNEKFLAENEYKTVGEALSRDENFASHKRNKRDDYTNSFSRSDFLHELEKIIEAQKRYALKNVSDTAINEMLYGLDDDKNVVNISSIMYQRPFMTEELIKKMVGNCTFEGNEKRAPRASYSFEIFRLASDLSHLVFIPRDASKRQARRENLEIRLSSEQINKVIEAAKNQKSLIYKKVRSIAGIGEDYVPKYTHGKKKDGDEFGEGNAFSSLKAYYDIKTALKNLPEDWAKIDNESTINQIAYILTTQKSDEGIKAELNALPISDDARNEIIKIKPANFGSFCHLSIKALQKITPHILNGMTYDKACEAAGYDFKKQSASLEQITNPVVKRAISQTLKVVRAIERKYGKPYFIKVETARDLAKNFKERNAIKKENEENQGYNEDIKSIIADGYEASPKTKGGKQLLSHLKELSVPLNKNADFNGQQIIKVKLYREQNGICLYSGKPIDFDTMLQDDNAYQIDHIVPFSRSNNDGITNKVLVLTEENQKKSNKTPFEYFGADENRWKEFVARVESIYKTRDIKTDDKVTNAINYKYNGYAMKKKQNLLLQDYKNDSWNVRALNDTRYITRFIQNYLRQNVDFAEGEGKQHVIAPNGTTTAYLRKRWGLAKDRSEDVLHHAKDAAIVAAIDQKIIMQANLHAKRHEIKELLAAAKTMEEKTDKLTGEIIDEDEFNKAQRRKNAMLVLSSKHFPQPWDDFGKEVMKRTLNIDIKTLQNELRGLDNYDEEFRLRVKPIFVSRMPRRKATGSAHKETIRSPKVKDDGQRTVRMPLKKVKRKDVENSTLKESDKWLYKKLLERLDACDDNPEKAFAEPIYKNEKKTDKNDNKLSPVSTIKVYSTQPSGFYINDDKAFVNNGSMVRLDVYQKPNKKGKIEHFFAPVYAHQVGKNKPTPTKILPVPKGFTDVDETFTKVCSLYPNDYVRCYFGNEIKEGYYVKYGINNGAMQVISHNSTGKDKDQLIQISPRSANLIERYDISILGDNYRWL

SEQ ID NO: 8338 - protein, 1131 aa, unidentified
  REGION 1..1131: note = Description of Unknown:uncultivated organism sequence
MAQKSSYSPKKYSLGLDIGTSSVGWAILDLDKERIHDLGVRIFERPEDPQNGDSLAKPRRDARSARRRLKRRRQRLNHLKQFFIDQNILTKYRVEEVLDYKSDFNKLDIYALRSKALTEELSPEELLKVLYQIAKRRGFKSNRKVVEESDKEGGRVTSALKTNEKFLADNNYTTVGEALSRDEKFALHKRNKRDDYTNSFARDDFLRELEAIIKTQRNYALKNVPEQAINELIYGINDKQVINVSAIMYQRPFMTKELIEKMVGKCTFEDGEKRAPKASYSFEVFRLASDLSHLVFIPRDASKRQAKRENLEVGLSPEQIKQVIELAKSQKSLTYKKVRSTAGISEDYVPKDVRGKKKDGDEFGEENAFGGLKAYNDIRSALKDLPEDWAKIDNESAINQIAYILTTQKADEGIRDELNLLPISDKAKEAIVKIKPTNFKAFGHLSIKALQKITPYILDGMTYDKACEAAGYDFKKQSTSLEQITNPVVKRAITQTLKVVRAIERKYGKPYFIKVETARDLAKNFKDRKAIENENKENQARNQSIIQTLNENGIVTPTGQQIIKVKLYREQQGKCLYSGNPIDFETMLRDDNAYQVDHIVPFSRSNNDGITNKVLVLTEENQKKADRTPFEYFGADEKRWKEFAARVESIYKTRDVKTSDKATNAINYKYNGYAMKKKQNLLLQDYKNDSWNVRALNDTRYITRFIQNYLRQNVDFAEGEEKQRFIAPNGTTTAYLRKRWGLAKDRAEDVLHHAKDAAVVAAIDQKIVMQANLYAKRHEIKALLAATKTMEEKTDKLTGEITDEDEFDKAQRRKAAILVLSSKHFPQPWDNFGKEVMKRTLNTDIATLQNELRGLDNYDEDFRLSVKPIFVSREIRHKIRGEAHESKLRSNRNRNGQNIIRIPLTELTLQRLENSLVKEEFDSQKNSNGSSLYEKLLARLNECNGDSKKAFNPPFKLYKGPKQDKNGNPISPVAAVKVYDKKGVVSVGRKANAPVALAEMVRIRVYKKDNQIYMIPDYRINILENKETMELLKPLKKVSKIDNSFNFIGYLYKGDLITIQKDSQTFVGYFVQFEGDNRITIKNHLAVDSSRDSKSTVKRESLSGINYLKIHKVDVLGDVNFSEGIVWPGAS

SEQ ID NO: 8339 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKRFFRDNNLLSKEQIEELLKPENKLDPYKIREKALNEKISNDELFVGLYHIAKRRGYKSNRKSAEENDKENSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCGFEKSEFRAPKASYSFEMFRLAENLAHLRVVINNEERNLTEEEISKVIEKAKDIKVLKYQHIREVLGYKKDENFSFPVNMIRGEIKKDSKNNGEENKFGELSFYHKVKAALSNTPEDWQKVCDNNYRMLDELGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKERKKIKKTQDENASYNESIKERLKNEFNVLSPTGLQITKFKLYEQQNWKCAYSGEDFVIENLFSNEHYAEIDHIIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRSGNGSINKETIRSPKIVEGYVDSKGKPAIARKQRVRLTSVDLKTLYDSPVRETDPALYEILKARLDEFDNKPEKAFGDPSNPVYKPTKNGSLGNIVRSIKVYDTQNSKSGFLINEGKAFVNNGDTIRLDVFKRKNYKGEFEYYFSPIYAHLLNAKKVEILPTPNGRSAAEKADFNKIRDENGKIFATEENGFVKQFSLYPNDYVRIYAKNKIVEGYYVKYNIANGSISLIGHDKADKKNIDGVSGGTITSIERYDISVLGDNYRWI

SEQ ID NO: 8340 - protein, 665 aa, unidentified
  REGION 1..665: note = Description of Unknown:uncultivated organism sequence
MNYSLGLDIGTTSCGWSVINLDKKRIEDLGVRIFEGAENPKNGQSLATPRREKRGMRKRLHRRRIRLNFLKQFFIQQKILSSQQIESLLAPHKNQIDPYTVREKALSEKLTPEELFIALYHIAKRRGYKSNSRAESNGDADENKKTLSAITANQAFLKEYQTVGEALNHAEKFKSHKRNKPNDYSNSFARADFEDEIKKILNKQSEFYPVLNEEKIQELLYSENFGILFQRRFMTPELIEKMRGKCQFEKEKPRAQRASYSFELFRLASDLVHLTYNMGNKLTIDEIASCIEKAKELSVLKYSHIQKILSENTSYEINFDYIRGLKRKDLIKDEAEAKKKALEQKFGELKFYHAIKKALKDQPAEWKEIESNIELFDNIGFVLTANKEDDSVREELNKLGLKPSVINGISNIKQSFAGFGHLSLEALRKITPFILQGETYDKAVVDAGYIFTAKLSGNSNRLPALSKEENNQITNPVVKRAISQSIKVVNAITLKYGAPTRLHIECASELAKSFDKRNDIIKIQDENRENNEKLVVRLKEEFHILSPTALQITKFKLYEQQDGKCLYSGKPIDLNRLFSDEHYCEIDHIIPRSRCGNDSMINKALVLNQENQEKRNQTPFEAWGSDEKRWQNFVARVESNPKIDAKKRARLLAKPRQKKIGMLEL

SEQ ID NO: 8341 - protein, 1119 aa, unidentified
  REGION 1..1119: note = Description of Unknown:uncultivated organism sequence
MTEKSSYSPKKYSLGLDIGTSSIGWAVLDLDKERIHDLGVRIFERPEDPQNGDSLAKPRRDARSARRRLKRRRQRLNHLKQFFIDQNILTKDQVEEVLDYRSDFNKLDVYELRAKALTEELSPEELLKVLYQIAKRRGFKSNRKVIEESDKEGGRVTSALKANEKFLADNNYTTVGDALSRDEKFAPHKRNKRDDYTNSFARDDFLRELEFIIKNQRKYALKNIPEQAINELIYGIDDGQATNVSAIMYQRPFMTRELIEKMVGNCTFEKDEKRAPKASYSFEVFRLASDLSHLVFIPRDTSKRQAKRENLEIRLSPEQISKVIDLTKNQKSLTYKKVRSTAGISEDYVPKDVRGKKKEGDEFGEDNTFGGLKAYSDIRLALKDLPEDWAKIDNESAINQIAYVLTTQKADEGIRAELDSLPLSDKAKEAIIKIKPTNFKAFGHLSIKALQNITPYILEGMTYDKACEAAGYDFKKQSASLEQITNPVVKRAITQTLKVVRAIERKYGKPYFIKVETARDLAKNFKDRKAIENENKENQARNQSIIQTLNENGVVTPTGQQIIKVKLYREQNGVCLYSGKSIDFETMLRDDNAYQVDHIVPFSRSNNDGMTNKVLVLTEENQKKSNQTPFEYFGADEKRWKEFAARVESTYKTRDIKTADKATNAINYKYNGYAMKKKQNLLLQDYKNDSWNVRALNDTRYITRFIQNYLRQMVDFVEGEEKQRVIAPNGTTTAYLRKRWGLAKDRAEDVLHHAKDAAVVAAIDQSIVRQANLFAKRGEIAALLSAVKTMEEKTDKLTGEIIDEDEFDKAQRRKDAAIVLSSKYFPQPWDNFGKEVMKRTLNTDIATLQNELRGLDNYDEDFRLSVKPIFVSRMPRRKATAQAHKETIRSSKVKDNDQRTVRMPLNKVKRKDVENSVLKESDKWLYDKLLERLNAHDNNPEKAFAEPVYKNDKKFDKNGKQLSPVSNIKVYSTQPSGFYINKGKAFVNNGSMVRLDVYQKPNKKGKIEHFFVPVYAHQVGKNKPTPTKILPAPKGFTDVDETFTKVCSLYPNDYVRCHFGNKIREGYYVSFNINNGAMQVMPHDAANKSNDSLIQISPRSANLIERYDIAILGDNYRWL

SEQ ID NO: 8342 - protein, 1133 aa, unidentified
  REGION 1..1133: note = Description of Unknown:uncultivated organism sequence
MAKKTVYLPKKYSLGLDIGTSSAGWAVLDLDKKRIHDLGVRIFERPEDSQNGDSLAKPRRDARSARRRLKRRRQRLNHLKQFFVDQNILTKNQVEEVLDYKSDFNKLDVYALRSKALTEELSPEELLKVLYQIAKRRGFKSNRKVVEESDKEGGRVTSALKTNEKFLADNNYTTVGEALSRDEKFALHKRNKRDDYTNSFARDDFLCELEAIIKTQRNYALKNVPEPAINELIYGIDDGQVTNVSAIMYQRPFMTKELIEKMVGKCTFEDGEKRAPKASYNFEVFRLASDLSHLVFIPRDASKRQAKRENLEVRLSPEQISKIINAAKSQKSLTYKKVRSIAGISEDYVPKDVRGKKKDGDKFGEKNVFGGLKAYNDIRSALKDLPEDWAKIDNESAINQIAYILTTQKADEGIRDELNLLPISNKAKEAIVKIKPTNFKAFGHLSIKALQKITPHILEGMTYDKACEAAGYDFKKQSASLEQITNPVVKRAITQTLKVVRAIERKYGKPYFIKVETARDLAKNFKDRKAIENENKENQARNQSIIQTLNENGIVTPTGQQVIKVKLYREQQGKCLYSGNPIDFETMLRDDNAYQVDHIVPFSRSNNDGITNKVLVFTEENQKKGDQTPFEYFGADEKRWKEFVARVESIYKTRDIKTSDKATNAINYKYNGYAMKKKQNLLLQDYKNDSWNVRALNDTRYITRFIQNYLRQNVDFAEGEEKQRIIAPNGTTTAYLRKRWGLAKDRTEDVLHHAKDAAVVAAIDQKIVYQANLFSKEQEMRLYLDNAKTIDEKRQILLRSTDENTGEITNETTFTQAQKDLAQAEYFKLRSDTETKNRFPAPWPDFSKEVMKRTLNTDIATLQNELRGLDKYDEEFRLSIKPIFVSRMPRRKATAQAHKETIRSPKVKDGDQRTIRMPLNKIKRKDVENSVLKESDKWLYDKLLEKLDTHGDNPEKAFAEPIYKNDKKFDKNGNQLSPVSTVKVYSTQPSGFYINDGKAFVNNGSMVRLDVYQKPNKRGEIEHFFVPVYAHQVGKNKPAPTKILPAPKGFTNIDETFTKVCSLYPNDYVRIYLKNEIREGYYVKYNVANGAMQLLPNYAPGKNQGTFIQVYGKNAQTIERYDISVLGDNCEWL

SEQ ID NO: 8343 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKRFFRDNNLLSKEQIEELLKPENKLDPYKIREKALNEKISNDELFVGLYHIAKRRGYKSNRKSAEENDKENSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSFEKSEFHAPKASYSFEMFRLAENLAHLRVVINNEERNLTEEEISKVIEKAKDIKVLKYQHIREVLGYKKDENFSFPVNMIRGEIKKDSKNNGEENKFGELSFYHKVKAALSNTPEDWQKVCDNNYRMLDELGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKERKKIKKTQDENASYNESIKERLKNEFNVLSPTGLQITKFKLYEQQNWKCAYSGEDFVIENLFSNEHYAEIDHIIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRLGKGSINKETIRSPKIVEGYVDSKGEPAIARKQRVRLTSVDLKTLYDSPVRETDPALYEILKARLDEFDNKPEKAFGDPSNPVYKPTKNGSLGNIVRSIKVYDTQNSKSGFLINEGKAFVNNGDTIRLDVFKRKNYKGEFEYYFSPIYAHLLNAKKVEILPTPNGRSAAEKADFNKIRDENGKIFATEENGFVKQFSLYPNDYVRIYAKNKIVEGYYVKYNIANGSISLIGHDKADKKNIDGVSGGTITSIERYDISVLGDNYRWI

SEQ ID NO: 8344 - protein, 1140 aa, unidentified
  REGION 1..1140: note = Description of Unknown:uncultivated organism sequence
MAEKSLYSPKKYSLGLDIGTSSVGWAVLDLDRERIHDLGVRIFERPEDPQNGDSLAKPRRDARSARRRLKRRRQRLNHLKQFFVDQNILTKDRVEEVLNYKSDFNKLDVYELRARALTEELSPEELLKVLYQIAKRRGFKSNRKVVEESDKEGGRVTSALKANEKFLADNNYTTVGDALSRDEKFALHKRNKRDDYTNSFARDDFLRELEAIFKTQRNYALKNVPEQTINELIYGIDDGQVTNVSAIMYQRPFMTKELIEKMVGNCTFEKDEKRAPKASYSFEVFRLASDLSHLVFIPRDTSKRQAKRENLEVRLSPEQICKVIDVAKSQKSLTYKKVRSTAGISEDYVPKDVRGKKKEGDEFGEDNTFGGLKAYSDIRLALKDLPEDWAKIDNESSINQIAYILTTQKADEGVVDELESSLATKMLSDTAKKAILTINPGHDSKKGIFKGFCHLSIKALQKITPHILKGMTYDKACEAAGYDFKKQSASLEQITNPVVKRAITQTLKVVRAIERKYGKPYFIKVETARDLAKNFKDRKAIENENKENQARNQSIIQTLNENGVVTPTGQQIIKVKLYREQNGVCLYSGKPIDFETMLHDDNAYQIDHIVPFSRSNNDGITNKTLVLTEENQKKGNQTPFEYFGADEKRWKEFVARVESIYKTRKIEPVDKNLSKEEKAQAKMTNAINYKYNGYAMKKKQNLLLQDYKNDSWNVRALNDTRYITRFIQNYLRQMVDFAEGEEKQRVIAPNGTTTAYLRKRWGLAKDRAEDVLHHAKDAAVVAAIDKSIVRQANLFAKRGEIAALLSAVKTIEEKTDKLTGEIIDEDEFDKAQRRKDAAIVLSSKCFPQPWDNFGKEVMKRTLNTDIATLQNELRGLDNYDEEFRLSIKPIFVSRMPRRKATAQAHKETIRSPKAKDGDQRTVRILLNKIKRKDVENSVLKESDKWLYDKLLERLDAHDNNPEKAFAEPVYKNDKKFDKNGKQLSSVSTIKVYSTQPSGFYINDSKAFVNNGSMVRLDVYQKPNKRGKIEHFFVPVYAHQVGKNKPAPTKILPAPKGFTDVDETFTKVCSLYPNDYVRCYFGNEIKEGYYVKYGINNGAMQVIAHSTASKDKDHLIQISPRSANLIERYDIAILGDNYRWL

SEQ ID NO: 8345 - protein, 1118 aa, unidentified
  REGION 1..1118: note = Description of Unknown:uncultivated organism sequence
MTQKSSYLPKKYSLGLDIGISSVGWAALDLDKERIHDLGVRIFERPEVPKTGKSLAEPRRAARSTRHRLRRRRQRLNYLKRFFIDNNLISESRIRDILSPTHPKKWRPAYDPYDLRIKGLGEKLSLEELFVALYHIAKRRGYKSNRISVEKQDVEGSQVLSAISENKLLLEKYKTKSVAKVLTLDEKFKNNKRNKTSTYKNSFVRKNFEDEVILLLESQKKFGLKLPYEKMQTLLYGDVKNGNYNGIFSQRPFMTKELIEKMRGNCEFEPEKPRAPKASYSFELFRLAQNLSHLRIVVDQETRQLSEDEIAKIIEKAKNVKVLKYEHIRDILGYKGDQSFSFAQGMIRGKIKNDDKKNGEGNKFDSMIFYHTVKKNLEQYPKDWNILAADNFELLDNAGLILTVNKDDSSLRAELSKLDISTDAIEALLPINVSGFVHLSFNSLHRITPWLLRGLNYSEAVEKAGYSFFQSLSGNKKKLPPLSKKQANQITNPVVKRAVSQTIKVVNAVIGKYGLPCSVKVEAASELAKNAQERDKIKKIQDENAEYNEKIKQKLINEFNIPTPTGLQITKFKLREQQNGVSLYSGTEINLENLFTDEHYGEIDHIIPFSRCGNDGLNNKVLVFTDENQEKGNLTPYEAWGGDDKKWTQFEARVRATAGLPAAKRDRLLSKSKPVEDWNVRALNDTRYISRFLRQYIRDNLDFPKIEGKTGAQRVFSPSGPITSYLRRVWRVGNKNRDDNNLHHAADACIIAATDPGIIQKVSSLNKYYELFRYSDKNEVIDKLTGEVLNRNQFEQHIADLEPWHDFGKEVRKRSKLYDTPSELHNELTGLKNYDEEFRLSTLPIFVSRMPKRSGKGSTNSETFRSPKIVEGYLDEKGKPAIARKQRVPLHSVDLKKLYDSPIRETDPKLYKILEQRLKDFNGDPAKAFVESVYKPTKDSKRGNIVRSIKIYNTRDSRSGFLVNEQRAFVNNGKTVRLDVYKRKNYKDIYEYYFAPVYTHLINAQKIEVLPTPTGRSKNEKADFDTIRTEDDKIYATLENGFIKQFSIYPNDYVRIYFGNEIVEGYYVKYNTNDGSLKLIKHSETSKNDNNLISKSAKTATLIERYDISALGDNYRWL

SEQ ID NO: 8346 - protein, 1119 aa, unidentified
  REGION 1..1119: note = Description of Unknown:uncultivated organism sequence
MAQKSSYSPKKYSLGLDIGTSSVGWAVLDLDKERIHDLGVRIFERPEDPQNGDSLAKPRRDARSARRRLKRRRQRLNHLKQFFVDQNILTKNQVEEVLDYRSDFNKLDVYALRAKALTEELSPEELIKVLYQIAKRRGFKSNRKVVEESDKEGGRVTSALNTNKKFLADNNYTTVGEALNRDKKFASHKRNKRDDYTNSFARDDFLCELEAIIKTQRNYALKNVPEQAINELIYGIDDGQVTNVSAIMYQRPFMTKELIEKMVGKCTFEDGEKRAPKASYSFEVFRLASDLSHLVFIPRDASKRQAKRENLEVRLSPEQIKQVIELAKSQKSLTYKKVRSTAGISEDYVPKDVRGKKKDGDEFGEENVFGGLKAYNDIRLALKDLPEDWAKIDNESALNQIAYILTTQKADEGIRAELDVLPLSDKAKEAIVKIKPTNFKAFGHLSIKALQRITPHILEGMTYDKACEAAGYDFKKQSASLEQITNPVVKRAITQTLKVVRAIERKYGKPYFIKVETARDLAKNFKDRKAIENENKENQTRNQSIIQTLNENGIVTPTGQQIIKVKLYREQNGVCLYSGKAIDFETMLCDDNAYQVDHIVPFSRSNNDGITNKVLVLTEENQKKGNQTPFEYFGADEKRWKEFAARVESTYKTRDIKTADKATNAINYKYNGYAMKKKQNLLLQEYKNDSWNVRALNDTRYITRFIQNYLRQNVDFAEGEEKQRVIAPNGTTTAYLRKRWGLAKDRAEDVLHHAKDAAVVAAIDQKIVMQANLHAKHHEIKALLAATKTMEEKTDKLTGEITDENEFDKAQRRKAAILVLSSKHFPQPWDNFGKEVMKRTLNTDIATLQNELRGLENYDDEFRLSVKPIFVSRMPRRKATAQAHKETIRSPRVKDNDQRTVRMPLNKIKRKDVENSVLKESDKWLYDKLLEKLDTHGDNPEKAFAEPIYKNDKKFDKNGNQLSPVSTIKVYSTQPSGFYINKGKAFVNNGSMVRLDVYQKPNKKGKIEHFFVPVYAHQVGKNKPTPTKILPAPKGFTDIDETFVKVCSLYPNDYIRIYLKNEIREGYYVKYNVANGAMQLLPNYAPGKNQNTFVQVYGKNAQAIERYDISILGDNYRWL

SEQ ID NO: 8347 - protein, 1101 aa, unidentified
  REGION 1..1101: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKRFFRDNNLLSKEQIEELLKPENKLDPYKIREKALNEKISNDELFVGLYHIAKRRGYKSNRKSAEENDKENSKVLSAISKNEKLLKEYKTVASALNSNEKFIAHKRNKAEDYSNSFVRANFEDEAKLILKIQKEFGLKLSDEKINFLLFGNEKEGNFNGIFSQRPFMTSELIMKMRGKCSFEKSEFRAPKASYSFEMFRLAENLAHLRVVINNEERNLTEEEISKVIEKAKDIKVLKYQHIREVLGYKKDENFSFPVNMIRGEIKKDSKNNGEENKFGELSFYHKVKAALSNTPEDWQKVCDNNYRMLDELGEILSCNKDDENLRKEISKLNLSEDAVEVLMMINVSGFGHLSFKALRKILPFLLKGDTYRNASENAGYDTKQQLSGDKNKLPPLSKEESAQITNPVVKRAVSQTIKVVNAIIREYGAPYQIKIEAAGDLAKNFKERKKIKKTQDENASYNESIKERLKNEFNVLSPTGLQITKFKLYEQQNWKCAYSGEDFVIENLFSNEHYAEIDHIIPFSRCGNDSLMNKVLVFTEENRQKGNLTPFEAWGANESRWANFEARINSMNLPFRKKERLLAKVPPKEDWNSRALNDTRYISKFLSQYLRKNLKFAKIENENPAQRVIVPNGSITSYLRRIWRVGSKDREENNLHHATDACIIAAIDQSVIQKISRLNKYFELFKYSAEDEVIDKITGEISSRADFEQTFEDIEPWRDFGKEVRKRTAHYESPMELRNELIGLENYDEEFRNKTTPIFVSRMPKRLGKGSINKETIRSPKIVEGYVDSKGKPAIARKQRVRLTSVDLKTLYDSPVRETDPALYEILKARLDEFDNKPEKAFGDPSNPVYKPTKNGSLGNIVRSIKVYDTQNSKSGFLINEGKAFVNNGDTIRLDVFKRKNYKGEFEYYFSPIYAHLLNAKKVEILPTPNGRSAAEKADFNKIRDENGKIFATEENGFVKQFSLYPNDYVRIYAKNKIVEGYYVKYNIANGSISLIGHDKADKKNIDGVSGGTITSIERYDISVLGDNYRWI

SEQ ID NO: 8348 - protein, 1103 aa, unidentified
  REGION 1..1103: note = Description of Unknown:uncultivated organism sequence
MKYSIGLDIGTTSIGWAIIDEDNKRIEKVGVRIFEKPENPKDGKSLSETRRTARSTRRRLKRRRQRLNFIKKFFRDNNLLTKEQIEELLRPENKLNPYKIREKALNEKISNEELFISLYHIAKRRGYKSNRKSAEEKDKEGSKVLSAISKNEKLLKEYKTVASALNSNEKFIAHKRNKAEDYSNSFVRANFEDEAKLILKTQKEFGLNLSDEKINFLLFGNEKEGNFNGIFSQRPFMTSELIMKMRGKCSLEKSELRAPKASYSFEMFRLAENLAHLRVVINNEERSLTEEEISKVIEKAKDIKVLKYQHIREVLGYKKDENFSFPANMIRGEIKKDSKNNGEENKFGELSFYHKVKTALSNTPEDWQKVCDDNYRMLDELGEILSCNKDDESLRKEISKLGLSEKAVEVLMTINVSGFGHLSFKALRKILPFLLKGDIYSDALKNAGYDVKQQLSGDKNKLPPLSKEDSAQITNPVVKRAVSQTIKVVNAIIREYGAPYQIKIEAASDLAKNFKERKKIKKAQDENASYNERIKERLQNEFNVPSPTGLQITKFKLYEQQNGKCAYSGKRLVLENLFSNEHYAEIDHIIPFSRCGNDSLINKVLVLTEENRQKGNLTPFEAWGADESRWAEYEVRVNSMNLPFRKKGRLLAKVPPKEDWNSRALNDTRYISKFLGRYLRKNLKFAKFDNENPAQRVIVPNGSITSYLRRVWRVGSKNREENNLHHATDACVIAAIDQNVIQKISRLNKYFELFKYSAEDEVIDKITGEISSRADFEQTFEDIEPWKDFGKEVRKRTAHYESPIELHNELIGLDNYDEEFRNKTTPIFVSRMPKRSGKGNINKETIRSPKIVEGYVDSKEKPVIARKQRIRLTSVDLKTLYDSPVRETDPALYEILKARLNEFGDKPEKAFGDPSNPVYKPTKNGSQGNIVRSIKVYDTLNSKSGFLINKGKAFVNNGDTIRLDVFKRKNYKGEFEYYFSPIYVHLLNAKKVEILPTPNGRSAAEKADFNKIRDEDGKIFATEENGFVKQFSLYPNDYVRIYAGNRIVEGYYVKYGITNGTLNLMNHDQTSKDNLSLKHIGCGTITFIERYDISVLGDNYRWI

SEQ ID NO: 8349 - protein, 1143 aa, unidentified
  REGION 1..1143: note = Description of Unknown:uncultivated organism sequence
MAQKYSYSPKKYSLGLDIGTSSVGWAVLDLDKERIHDLGVRIFERPEDPQNGDSLAKPRRDARSARRRLKRRRQRLNHLKQFFIDQNILTKDRVEEVLDYKSDFNKLDIYALRSKALTEELSPEELLKVLYQIAKRRGFKSNRKVVEESDKEGGRVTSALKTNEKFLADNNYTTVGEALSRDEKFALHKRNKRDDYTNSFARDDFLCELEAIIKTQRNYALKNVPEPAINELIYGIDDGQVTNVSAIMYQRPFMTKELIEKMVGKCTFEDGEKRAPKASYSFEIFRLASDLSHLVFIPRDASKRQAKRENLEIRLSPEQIKQVIDLAKSQKSLTYKKVRSTAGISEDYVPKDVRGKKKDGDEFGEENVFGGLKAYNDIRFALKDLPEDWAKIDNESAINQIAYTLTTQKADEGIRTELDTLPLSDKAKEAIIKIKPTNFKAFGHLSIKALQKITPHILDGMTYDKACEAAGYDFKKQSASLEQITNPVVKRAIAQTLKVVRAIERKYGKPYFIKVETARDLAKNFKDRNAIKKENEENQGYNEDIKSIITDGYEASPKTKGGKQLLSHLKEFNVRLNKNADFNGQQIIKVKLYREQNCVCLYSGKPIDFETMLHDDNAYQVDHIIPFSRSNNDGMTNKVLVLTEENQKKGNQTPFEYFGADEKLWKEYVARVGSTYQTREVKKGDKDAGINYKYNGYAMKKKQNLLLQDYKNDSWNVRALNDTRYITRFIQNYLRQNVDFAEGEEKQRVIAPNGTTTAYLRKRWGLAKDRAEDVLHHAKDAAVVAAIDQKIVMQANLYAKHHEIKALLAATKTMEEKTDKLTGEITDEDEFDKAQRRKAAILVLSSKHFPQPWDNFGKEVMKRTLNTDITTLQNELRGLDNYDEDFRLNVKPIFVSRMPRRKATAKAHKETIRSPKVKDSDQRTVRTPLNKIKRKDVENSVLKESDKWLYNKLLERLDTHDNNPEKAFAEPIYKNDKKFDKNGKKLSPVSTIKVYSTQPSGFYINDGKAFVNNGSMVRLDVYQKPNKKGKIEHFFVPVYAHQVGKNRPTPTKILPTPKGFTDVDETFTKVCSLYPNDYVRCYFGNKIKEGYYVKYGINNGAIQVIAHGTTSKDKDHLIQISPRSANLIERYDISVLGDNYRWL

SEQ ID NO: 8350 - protein, 1119 aa, unidentified
  REGION 1..1119: note = Description of Unknown:uncultivated organism sequence
MTEKSSYSPKKYSLGLDIGTSSIGWAVLDLDKERIHDLGVRIFERPEDPQNGDSLAKPRRDARSARRRLKRRRQRLNHLKQFFIDQNILTKDQVEEVLDYRSDFNKLDVYELRAKALTEELSPEELFKVLYQIAKRRGFKSNRKVIEESDKEGGRVTSALKANEKFLADNNYTTVGDALSRDEKFAPHKRNKRDDYTNSFARDDFLRELEFIIKNQRKYALKNIPEQAINELIYGIDDGQATNVSAIMYQRPFMTRELIEKMVGNCTFEKDEKRAPKASYSFEMFRLASDLSHLVFIHRDASKRQAKRENLEVRLSPEQISKVIDAAKSQKSLTYKKVRSTAGISEDYVPKDVRGKKKEGDEFGEDNTFGGLKAYSDIRLALKDLPEDWAKIDNESAINQIAYVLTTQKADEGIRAELDSLPLSDKAKEAIIKIKPTNFKAFGHLSIKALQNITPYILEGMTYDKACEAAGYDFKKQSASLEQITNPVVKRAITQTLKVVRAIERKYGKPYFIKVETARDLAKNFKDRKAIENENKENQARNQSIIQTLNENGVVTPTGQQIIKVKLYREQNGVCLYSGKSIDFETMLRDDNAYQVDHIVPFSRSNNDGMTNKVLVLTEENQKKSNQTPFEYFGADEKRWKEFAARVESTYKTRDTKTADKATNAINYKYNGYAIKKKQNLLLQEYKNDSWNVRALNDTRYITRFIQNYLRQDVDFAEGEEKQRVIAPNGTTTAYLRKRWGLAKDRNEDVLHHAKDAAVVAAVDQNIVRQANLFAKRSEIATLLAAAKTMEEKTDKLTGEIIDEDEFDKAQRRKDAAIVLSSKYFPQPWNNFGKEVMKRTLNTDIATLQNELRGLDNYDEDFRLSVKPIFVSRMPRRKAVAQAHKETVRSPKVKDNDKRTVRMPLNKVKRKDIENSVLKESDKWLYDKLLERLNAHDNNPEKAFAEPVYKNDKKFDKNGKQLSPVSNIKVYSTQPSGFYINNGKAFVNNGSMIRLDVYQKPNKKGKIEHFFVPVYVHQVGKNKPTPTKILPAPKGFTDVDETFTKVCSLYPNDYVRCYFGNEIKEGYYVKYGINNGAMQVIAHSTASKDKDHLIQISPRSANLIERYDIAILGDNYRWL

SEQ ID NO: 8351 - protein, 1131 aa, unidentified
  REGION 1..1131: note = Description of Unknown:uncultivated organism sequence
MAQKSSYSPKKYSLGLDIGTSSVGWAVLDLDKERIHDLGVRIFERPEDPQNGDSLAKPRRDARSARRRLKRRRQRLNHLKQFFVDQNILTKNQVEEVLDYRSDFNKLDVYALRAKALTEELSPEELIKVLYQIAKRRGFKSNRKVVEESDKEGGRVTSALKTNEKFLADNNYTTVGEALSRDEKFALHKRNKRDDYTNSFARDDFLRELEAIIKTQRNYALKNVPEQAINELIYGINDKQVINVSAIMYQRPFMTKELIEKMVGKCTFEDGEKRAPKASYSFEVFRLASDLSHLVFIPRDASKRQAKRENLEVGLSPEQIKQVIELAKSQKSLTYKKVRSTAGISEDYVPKDVRGKKKDGDEFGEENAFGGLKAYNDIRSALKDLPEDWAKIDNESAINQIAYILTTQKADEGIRDELNLLPISDKAKEAIVKIKPTNFKAFGHLSIKALQKITPYILDGMTYDKACEAAGYDFKKQSTSLEQITNPVVKRAITQTLKVVRAIERKYGKPYFIKVETARDLAKNFKDRKAIENENKENQARNQSIIQTLNENGIVTPTGQQIIKVKLYREQQGKCLYSGNPIDFETMLRDDNAYQVDHIVPFSRSNNDGITNKVLVLTEENQKKADRTPFEYFGADEKRWKEFAARVESIYKTRDVKTSDKATNAINYKYNGYAMKKKQNLLLQDYKNDSWNVRALNDTRYITRFIQNYLRQNVDFAEGEEKQRFIAPNGTTTAYLRKRWGLAKDRAEDVLHHAKDAAVVAAIDQKIVMQANLYAKRHEIKALLAATKTMEEKTDKLTGEITDEDEFDKAQRRKAAILVLSSKHFPQPWDNFGKEVMKRTLNTDIATLQNELRGLDNYDEDFRLSVKPIFVSREIRHKIRGEAHESKLRSNRNRNGQNIIRIPLTELTLQRLENSLVKEEFDSQKNSNGSSLYEKLLARLNECNGDSKKAFNPPFKLYKGPKQDKNGNPISPVAAVKVYDKKGVVSVGRKANAPVALAEMVRIRVYKKDNQIYMIPDYRINILENKETMELLKPLKKVSKIDNSFNFIGYLYKGDLITIQKDSQTFVGYFVQFEGDNRITIKNHLAVDSSRDSKSTVKRESLSGINYLKIHKVDVLGDVNFSEGIVWPGAS

SEQ ID NO: 8352 - protein, 1125 aa, unidentified
  REGION 1..1125: note = Description of Unknown:uncultivated organism sequence
MYYNVFMKYSLGLDIGVTSVGWAVVDLDKKRIHNLGVRIFEKAEDPQNGDPLAKPRREARSARRRLKRRRQRLNSLKKFFINQHILTEQEVNEVLSETSRYNTLDVYALRSKALEEALTPEELLKVFYQIAKRRGFKSNRKIQEAADVEGGRVTKALKANEQLLVDRGYKTAGQALALDEMYAKHRRNKHDDYTNSFARQDFENELQQIIATQKRYVLKNISDSDVSQLIYGIHDGETINKNAILYQRPFMTKELIESMVGECTFEKNEKRAPRASYSFELFRLVGDLAHLEYIPKGIKKRETNATRLTPDQIKAVVTVAKKGGKLTYKKVREAAGISDDFAASYVRGKISDDDPYGETNDFGNMKAYHDLRLALKGFPEDWMKVDNETVLNQIAYILTTEKSDEAILKALEAIAVSDEAKQAILKIKPTNFKSFGHLSIKALQNITPNIMQGMAYDKACEVAGYDFRKKGVNLEQITNPVVKRAIAQTLKVVKAVERKYGKPYYIRVETARELAKNFKDRKAIELEQKENQERNKNLISKLEEHGITDPTGMQIIKFKLYNEQNAKSLYSGEPIDLYRLLHDDNAYQVDHIIPFSRSGNDSLANKTLVTTAENQEKGNRTPYEAFGGNEMRWSQFVANVEAIYKTRVVEKGDKSAKDNYAFNGYAFKKKGNLLATAYARSGWAESQRALNDTRYITKFVQNYLRQTADFAKGERENEQRVFAPNGTLTAYMRKRWGLAKDRSEDVLHHAKDAAVVAVMDQSMIYRANQYAKSTEMRQYLMNAKTIHEKAQLLVDLTDKETGEIADDSKFKEAQEARRRAEHVKETMDVLSTDRFPEPWPRFREEVDWRTRPISTEELHGKIKNFETYDTRFAESVQPIFVSRMPNRKAKGGAHKETLRSIRVDEDNMRTVRMPLTSIKLKDLENASVKNSDPQLYETLKLRLEECGDKPEKAFAEPVYKRDKYGNNAHEIRAIKVASKQPSGFSINNGKAFVNNGSMVCVDVFQKQNAKGKLEHFFVPVYTHQIPLEKRGEKITKILPAPKGFTDVDESFTKVTSLFPNDYVRVYFGNKVVEGYYVKYGTASGQMALISHLAPGKDDIITCSARSAVSIERHDISILGDNAPRI

SEQ ID NO: 8353 - protein, 1099 aa, unidentified
  REGION 1..1099: note = Description of Unknown:uncultivated organism sequence
MRYSLGLDIGTASVGYAVLNEDINRIEYVGVRIFERPENPKNGESLALPRRTKRSMRRRFNRRKQRLNYLKNYFVEHNLLGREEINNILDPTKEPKFDPYELRSRGLSEKLSNDELFAALYCIAKRRGYKSNRKKLEESDKESGRVLTAIKNNASMFEKYQTIGDALHRDEKYKSNKRNKRDSYENSFIREDFEKEAKKLLESQQWSEAAIEELFHDPSKRWGGIFDQRPFMTKELIEKMRGNCIFEKGEKRAWKASYTFDLFRLAQDAINLAFIDEDGVEYSLSSEQIAQIVELAKNTKSVKYKHIRKLLEEDGGKISFKYIRGQKRDEAIEKAEDHEFCSLKYYHAIKKNLTADDFSKIEQNIDDFDQIGYILTVCKDDATIETELKKLNLSGESIEKLLKQNFSGFAHLSIKALRKITPHLLAGDTYDKAVEAEYPGEFAAKLSGDSNVLPPLSEVELSQITNPVVKRAIGQTRKIINAIIGKYGAPAQIKIECTNELAKSFKERKTISDTQEENRRANDARVEKLKELGVVTPTGQQILKYRLREEQLCKCAYCGKSLGPEIFHDDKLTEVDHIIPFSRCGNDSNSNKVLVCSQCNQEKSSKTPFEKWGNDTARWQIITDIANSLAIANPRAKDAKVKRILAENAPKEEWNSRALNDTRYIMKFMSQYIKKNLKFSDECKGAQKVILPTGFITSYLRKMYHLGAKDRDFNNCHHAVDACVIASVSQKQIQKFALWNRCKEEGASYHTEISFDDNGELVQKTHKEYEEMTAELLPWEDFDKEVKIRCGMTHDQTQVEDEEEFRDKLKCFASYDEEFLSKVKPIFVSRMPKRNTKGSAHKDTVRSIKSKDGENRTTKKRLDEKFTLDDLNNSILVESDKVLYNQLKKLLEEKGKEAFAEPIYKNDKRFDKNGRPLSPVTSVKVYAKNPLSSGILINHGTQYVNNGDIVKLEVYRRKKDTGDGYDYFGAPVYVHALHKKGPREILPTPVGRGKAQQAVYNAMRTPDGHIFADEKFGFEKVTDVYPNDYIRIYLNDGRIAEGYYISYDISNTRISFINHSAADKTQGNLLRIYLSSATNFELLNISLLGDNYKPAKKKE

SEQ ID NO: 8354 - protein, 1099 aa, unidentified
  REGION 1..1099: note = Description of Unknown:uncultivated organism sequence
MRYSLGLDIGTASVGYAVLNEDINRIEYVGVRIFERPENPKNGESLALPRRTKRSMRRRFNRRKQRLNYLKNYFVEHNLLGREEINNILDPTKEPKFDPYELRSRGLSEKLRNDELFAALYCIAKRRGYKSNRKKLEESDKESGRVLTAIKNNASMFEKYQTIGDALHRDEKYKSNKRNKRDSYENSFIREDFEKEAKKLLESQQWSEAAIEELFHDPSKRWGGIFDQRPFMTKELIEKMRGNCIFEKGEKRAWKASYTFDLFRLAQDAINLAFIDEDGVEYSLSSEQIAQIVELAKNTKSVKYKHIRKLLEEDGGKISFKYIRGQKRDEAIEKAEDHEFCSLKYYHAIKKNLTADDFSKIEQNIDDFDQIGYILTVCKDDATIETELKKLNLSGESIEKLLKQNFSGFAHLSIKALRKITPHLLAGDTYDKAVEAEYPGEFAAKLSGDSNVLPPLSEVELSQITNPVVKRAIGQTRKIINAIIGKYGAPAQIKIECTNELAKSFKERKTISDTQEENRRANDARVEKLKELGVVTPTGQQILKYRLREEQLCKCAYCGKSLGPEIFHDDKLTEVDHIIPFSRCGNDSNSNKVLVCSQCNQEKSSKTPFEKWGNDTARWQIITDIANSLAIANPRAKDAKVKRILAENAPKEEWNSRALNDTRYIMKFMSQYIKKNLKFSDECKGAQKVILPTGFITSYLRKMYHLGAKDRDFNNCHHAVDACVIASVSQKQIQKFALWNRCKEEGASYHTEISFDDNGELVQKTHKEYEEMTAELLPWEDFDKEVKIRCGMTHDQTQVEDEEEFRDKLKCFASYDEEFLSKVKPIFVSRMPKRNTKGSAHKDTVRSIKSKDGENRTTKKRLDEKFTLDDLNNSILVESDKVLYNQLKKLLEEKGKEAFAEPIYKNDKRFDKNGRPLSPVTSVKVYAKNPLSSGILINHGTQYVNNGDIVKLEVYRRKKDTGDGYDYFGAPVYVHALHKKGPREILPTPVGRGKAQQAVYNAMRTPDGHIFADEKFGFEKVTDVYPNDYIRIYLNDGRIAEGYYISYDISNTRISFINHSAADKTQGNLLRIYLSSATNFELLNISLLGDNYKPAKKKE

SEQ ID NO: 8355 - protein, 1099 aa, unidentified
  REGION 1..1099: note = Description of Unknown:uncultivated organism sequence
MRYSLGLDIGTASVGYAVLNEDINRIEYVGVRIFERPENPKNGESLALPRRTKRSMRRRFNRRKQRLNYLKNYFVEHNLLGREEINNILDPTKEPKFDPYELRSRGLSEKLSNDELFAALYCIAKRRGYKSNRKKLEESDEESGRVLTAIKNNASMFEKYQTIGDALHRDEKYKSNKRNKRDSYENSFIREDFEKEAKKLLESQQWSEAAIEELFHDPSKRWGGIFDQRPFMTKELIEKMRGNCIFEKGEKRAWKASYTFDLFRLAQDAINLAFIDEDGVEYSLSSEQIAQIVELAKNTKSVKYKHIRKLLEEDGGKISFKYIRGQKRDEAIEKAEDHEFCSLKYYHAIKKNLTADDFSKIEQNIDDFDQIGYILTVCKDDATIETELKKLNLSGESIEKLLKQNFSGFAHLSIKALRKITPHLLAGDTYDKAVEAEYPGEFAAKLSGDSNVLPPLSEVELSQITNPVVKRAIGQTRKIINAIIGKYGAPAQIKIECTNELAKSFKERKTISDTQEENRRANDARVEKLKELGVVTPTGQQILKYRLREEQLCKCAYCGKSLGPEIFHDDKLTEVDHIIPFSRCGNDSNSNKVLVCSQCNQEKSSKTPFEKWGNDTARWQIITDIANSLAIANPRAKDAKVKRILAENAPKEEWNSRALNDTRYIMKFMSQYIKKNLKFSDECKGAQKVILPTGFITSYLRKMYHLGAKDRDFNNCHHAVDACVIASVSQKQIQKFALWNRCKEEGASYHTEISFDDNGELVQKTHKEYEEMTAELLPWEDFDKEVKIRCGMTHDQTQVEDEEEFRDKLKCFASYDEEFLSKVKPIFVSRMPKRNTKGSAHKDTVRSIKSKDGENRTTKKRLDEKFTLDDLNNSILVESDKVLYNQLKKLLEEKGKEAFAEPIYKNDKRFDKNGRPLSPVTSVKVYAKNPLSSGILINHGTQYVNNGDIVKLEVYRRKKDTGDGYDYFGAPVYVHALHKKGPREILPTPVGRGKAQQAVYNAMRTPDGHIFADEKFGFEKVTDVYPNDYIRIYLNDGRIAEGYYISYDISNTRISFINHSAADKTQGNLLRIYLSSATNFELLNISLLGDNYKPAKKKE

SEQ ID NO: 8356 - protein, 1095 aa, unidentified
  REGION 1..1095: note = Description of Unknown:uncultivated organism sequence
MRYSLGLDIGTTSIGWAVIDEDKKRIHDVGVRIFEKPEDPKTGASLAEPRRTARGTRRRLKRRRQRLNALKNFFVKNHLLTKDDIDNLLTPENHHNPYEIRERAVKEQISNEELFIALYNIAKRRGYKSNRKSLEEKDSEGSRVLSAISENKVILENYASVAGALNKNSKFADHKRNKRDSYVNSFARQDFLNEAKEIIEKQKSFGLKLSDDTVHTLLYSDEHNGNFSGIFSQRPFMTSELIKKMRGTCELEPGEFRAPRASYSFELFRLAQNLAHLRVTIGSETRALTADEISSCIEKAKSIKTLKYSHVRDVLGYKNDSSFEFARGMIRGKVKSDDKTNGEGNKFDEMTFYHAVKSALKNIPNDWDRIESNQEIFDAIGEVLTINKDDVNLRKELKNLALSDEAITELLKLDFSGFGHLSLKALHKITPFLLKGQTYDDAVTSAGYQFSQKLSGDKNKLPPLSKVHGQQITNPVAKRAISQSIKVINAIISKYGAPNKIKVEAAGDLAKTFADRQKIKKLQDENADYNEKLKNKLIHEFHVTTPTGLQITKFKLYNQQNGKCMYSGKPLDLSRLFSDERYGEIDHIIPFSRCGNDGLNNKALVLTEENQQKGNLTPHEAWGSDEVKWRDFEARVKATFLPFAKKDRLLAKSPPNEEWNQRAINDTRYISKFLRSYIRENLKFADFPDEKGVQRVITPGGAITSYLRRVWHVGGKSRDENNLHHATDACIIAAVDQGTIQKVSRLNKYYELFKYADTNEVTDRVTGEVVRRGELEHHSYEVEPWEDFGKEVRIRTGMNTIKNDDESTRLQTPDEMRNELRGLASYDEEFRLSTHPIFVSRMPKRSGKGATNKETIRSPKIVENYDNNKGENVIARKQRVPLTNIRLKDLYDSPVRQDAKLYEVLKQRLEEYGDDPQKAFASDNPIYKPTKDGSRGNVVRSIKVYDTQNSKTGFYINDGKAFVNNGGMTRLDVYQKQSTKGKIEHFFVPVYTYQIGFEKSGQKITKIMPEPKGFTDVNDTFTKVTSLFPNDYVRIYINNKIEEGYYRAYDVAAGQITLLSHSASDAKSTIRVSARSASSIERFDISILGDNYKWI

SEQ ID NO: 8357 - protein, 1121 aa, unidentified
  REGION 1..1121: note = Description of Unknown:uncultivated organism sequence
MRDLSYRIGLDIGIGSIGWAVVSSETEDHPARIENFGTRIFDSGEDPKTRESLCQARRADRGVRRLERRRAFRKEMLKNHFQNIGLLNNTFNDDYESCRDDDVYLLKVKGLDGKLEAAELFKCLAHTCNHRGYKDFYEPEDDDENEESGVNEKAANLFEKEFAASGKRTVSEYLVEKYFNNGFVKFRNRSGSDAPYMLIRRSLLKDEAEKIIKKQSEYYPCLGGINAERTVSIIFSQRDFEDGPGDPNDPHRRYHGFLETLGRCPYYKDEKRGFRGTVISDVFAVTNTLSQYVFFEKETGECRLDPKIANELVSYLLTNAGLTMTEVKKILKSHGYELKKSEKSDDKAISKAVKFLSIAKKCVEEAGKSWEALISEDQFDAANLSTLHRIGELISKFQTPSRRVQEMKKAGIDGDLIKAFSGKKISGTSSVSYKYMTDSINAFLSGDIYGNFQANFIKENAAVKEEERSYKLEPRHIDDPEVRDNRVVFKAINETRKVVNAIIDIYGSPEDIVIEVASELGKSVEARIEETKRQRANEKENDRIKSEIAKLLSIDVQSVKTTMIERYKLYNIQEGKCAYSLEPLGDLKDVVENVNKVYEIDHIVPFSLILDNTLNNKALVFTRENQTKGQRTPLMYLSEEKAKEFLAFSNHLFSKKTGGISKTKLEYLKLETIYGEAAAEKLNAWKSRNINDTRYITKYIAGLFDKQLIFAGDKKQHVFTVKGSVTQKFRREWFRGTEWGKDEKDRTTYLNHALDALVAANLTKAYIEIGSDAIKLSQIYRAHRYQITEEYESYLDKCVKKMSKYYGFSEGYTKKLLSKPERIPSFVPRLKEEVAVRFNDSDSEAFDKGVSKLYSAEAPFIDPPHIPITSHKQNKKFKGCIADSNPIRVEEIDGEAHKIRRIDIKTLSAKKLKDLYTGDVSLREELAAMLDGKPESYTVGDSLKESGKEFFLSKSGAVIRKVSVDDGIVSNYYRKEIKDGQYSTLGMLKYYCIEVYKDAKGKTRIYGIRFVDVVKKNKKLYQKAESYPEDYASHVMYLFTGDFVRITDKKGKLKFEGFYQAVKNINSSILYFSPVNLANTVIKGISLTDNIEKYYVDILGRIGGKIRCSEPLQSTAEKKSL

SEQ ID NO: 8358 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKNFNPNIFQLKYDGLSKKLSPEEIFAIIIHFCNHRGYKDFYEEDATTINEKERGKIKTALSNFEKIYKDNGYISVSEMILKEPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKINDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTKILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8359 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKIFNPNIFQLKYDGLSKKLSPEEIFAIIIHFCNHRGYKDFYEEDATTINEKERGKIKTALSNFEKIYKDNGYISVSEMILKDPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKINDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTKILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHQTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8360 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKNFNPNIFQLKYDGLSKKLSPEEIFAIIIHFCNHRGYKDFYEEDTTTTNEKERGKIKTALSNFEKIYKDNGYISVSEMILKDPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKINDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTKILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLKLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8361 - protein, 1113 aa, unidentified
  REGION 1..1113: note = Description of Unknown:uncultivated organism sequence
MNYRIGLDIGIGSVGWAVVSSEGDGHPARIEDFGTRKFKSGENPKSSDTLCSERRGFRGNRRLTRRRSFRKKLLLNHFKNIGLLNNTFYDDYADCKDDDVYCLKVKGLDEKLLPAELYKCLVHTCNHRGYRDFYEPDDSDEEAGKNESAANDFEKMFIKSGKRTVSEYLVSDHVSNGFVNYRNRNGGANPYLLVRRKLLQEEVALLLKKQSEFYSCLDSRNTNQIITIIFNQRDFEDGPGNPDDKSRRYYGSLGKCPFYSVEDRGFRGTVIADVFAVTNTLSQYRFVNKETGEYELEPKVAEKLIDHLLANAKLSMTDVKKILKEEGFELLKSERSDDKALGKAIKFLSIAKKCAEEAEFDWKELINEYQFDPEIPTVLHSIGELISKYQTPSRRRKEMKKSGIDERLIKTFSNKKISGTASASYKYMCDAIKAFLSGDTYGNYQANFKKVNVDSENKEKSFKLAPSDIDGADVRNNRVVFKAINETRKIVNAIIDVYGSPEDIVIEVASELGESFEMRARETKRQRENEKSNDKIKSEIASLLSIDIGDVKGAMIERYKLYKEQEGKCAYSVRPLGDIKEVVENRNHAYEIDHIVPYSLILDNTLNNKALVYTEENQKKGQRTPLMYMNEEKSQEFLSFVNHMFSRKTDSIGRKKFEYYRLETIYGEKSEEILSAWKSRNINDTRYITKYIAGLFERKLLFSGEKKQHVFTVKGAVTQKFRREWFKDSAWGEYEKKRDTYLNHALDALIAANLTKPYIEIGSDALRLISIYKSHKSRITPEYDEYLEKCIAKMREYYGFNDEYTRKLLSRTGRAPSFVPRLVDEVRVRFYDEDEKVFNENVEKLYGNEAGFIVPPHMPITSHKQEKKYKGKIADENPLKIVEIDGLPHKIKRIDIKSVSEKTLSKVYTEDKSLIGQLTTILKGKGEKYTIADYLKDNSEEYFVSKEGTLIRKISTDGGVVSNFYRKEIENGNYTYLGMLKYYCVEVYKDSKGNTKTCGVRFVDIVNRNGKLYRKEESLPGDYSKHVMYLFANDYVTIFDGKGETKFSGYYISVENINSSKFSFKLKNYSSNVIKSISREDTIKKFSISLLGKIGGEIKCSEPLPCIKEREYR

SEQ ID NO: 8362 - protein, 1046 aa, unidentified
  REGION 1..1046: note = Description of Unknown:uncultivated organism sequence
MMKKRKYGIGLDIGVGSVGFAVLSWTDEEDARIETLGARLFASGETADRKASLSQERRGYRSARRLIRRRKHRKDRVKFFLQKIGLISKEKLQAWQEVNGNQNVLRTRLQGLTEKLTPEEIADTVIHICNHRGYREFYEDENDDKDAGLIKTGLSDFEKCYHAGGYKSVADMLLNDEKFQTETEFTDYHNHKNGERYILIKREYVRDELLAILRRQQQFYPQLNDSNIEFLCDEIIFAQRDFETGPGNPNDEKRKFMGFLDTLGKCMFYKTEDRAFRSTVLADIYSLVNCLSQMSFVDTATGEIVLPEAAAEEIINTALINGGMTESDLKKLLKKYGIEMRKPGKLEVKLPDTVKTLKALKNILEQCGYSYEELIAENQFDLARPSRLQLLCEDLSKNITPQRRKKVLAKAGWNKELQQAMLRKKFGGTASVCKKYMLEAINAFRHGETYGNFQARRLQERAAEQQPQEKHLLLPPLTMKQDEEVTKNIVVFKAINETRKVLNAIIRRYGSPEYINIEVADDLGRSVSERMKLTKMMRDNEKARQKIAEKIIELGLRKEGEVKEGDIARYKLWQEQGGIDLYSGDPIAENAVLSSIYDIDHIVPFSLILDDTLQNKALVNMGANRQGKHQQVPLQYLQGEQKTKFLQNVNLLFKKGKISAKKYKYLLLPNLYNAEVLAEWKSRNINDTRYITRYIVNYLTANLKFANEDKKKHVYAVKGAITSRMRKKWLNKKSWGSVEKDRSNNLHHAADALVIANLTPAYVEIVSDNMKLNKIYREHHKQISFEYNDYLEKAVKKMQKYYGFNEAYARKLLEAKGRIPSIIKNLEREADIRLTDESMEFYQDKDASGFAEKAADFYRDDPQFAAGLRMPLVSYKQNKKFQGKITDDNPVKKAARKNTSLVKLDTLGNENILTASKYYCVELYETADGKNNLRGIRYADLKKQGKKLYLTAENPADYKRHKMYLFANDYIEVINQKGECKFKGFYKSVFNINENRVYCNEGNTSKSINKTIAAKDIVKKYNIDILGEMGGEVKCSVPFMLLREKK

SEQ ID NO: 8363 - protein, 1045 aa, unidentified
  REGION 1..1045: note = Description of Unknown:uncultivated organism sequence
MMKRKYGIGLDIGVGSVGFAVISRTNDEDARIETLGARLFDSGETADRKASLSQERRGYRSVRRLIRRRKHRKDRVKFFLQKIGLISKEKLQAWQEVNGNQNVLQTRLNGLTEKLAPEEIADCIIHICNHRGYREFYEDENNDKDAGLIKTGLSDFEKCYHDGGYKSVADMLLHDEKFKTETEFTDYHNHKNGERYILIKREYVREELLAILHRQQEFYPQLTDDNITFLCDRIIFAQRDFETGPGDPNDKDRKFMGFLDTLGKCMFYKTEDRAFRSTVLADIYSLVNCLSQMSFVDTATGEIILPEDAAEDIINTALLNGGMTESDLKKLLKKHGLEMRKPGKLEVKIPDTVKTLKVLKSVLEQCGYDYTELIAENQFDLEHPSRLQQLCRILSENITPRRRKQALGKAGWNKALQEAMLRRKFGGMASVCEKYMLEAISAFKHGETYGNFQARRLKERAAEQPTQEKHLLLPPLTMKQDEEITKNIVVFKAINETRKVLNAIIRRYGSPEYINIEVADDLGRSVSERMKLTKMMRDNEKARQKIAEKIIELGLRKEGEVKEGDIVRYKLWQEQGGIDLYSGEPIAENAVLSGIYDIDHIVPFSLILDDTLQNKALVNMGANRQGKHQQVPLQYLQGEQKTRFLQNVNLLFKKGKISAKKYKYLMLPNLYDAEILAEWKSRNINDTRYITRYIVNYLTANLKFANEEKKKNVYAVKGAITSRMRKNWLNKKSWGSIDKDRSNNLHHAADALVIANLTPAYVEIASDNMKLNKIYREHHKQISFEYTDYLEKAVRKMQKYYGFNEDYARRLLEAKGRIPSIIKNLEREADIRLTDESMEFYQDKDASSFAEKVADFYRDDPQFAAGLQMPLVSYKQNKKFQGKITDDNPVKKSARKNSSLVKLDTLGNENILTASKYYCIELYETTDGKNNLRGIRYADLRKQNKKLYLTAENPADYKQHKLYLFANDYIEVTNKKGECKFKGFYNSVFNINENRIYCSERNSSKNINKTIAAQDVIKKYNIDILGQIGGEVKCSAPFMLLREKK

SEQ ID NO: 8364 - protein, 1046 aa, unidentified
  REGION 1..1046: note = Description of Unknown:uncultivated organism sequence
MMKKRKYGIGLDIGVGSVGFAVLSWTDEEDARIETLGARLFASGETADRKASLSQERRGYRSARRLIRRRKHRKDRVKFFLQKIGLISKEKLQAWQEVNGNQNVLRTRLQGLTEKLTPEEIADTVIHICNHRGYREFYEDENDDKDAGLIKTGLSDFEKCYHAGGYKSVADMLLHDEKFQTETEFTDYHNHKNGERYILIKREYVRDELLAILRRQQQFYPQLNDSNIEFLCDEIIFAQRDFETGPGNPNDEKRKFMGFLDTLGKCMFYKTEDRAFRSTVLADIYSLVNCLSQMSFVDTATGEIVLPEAAAEEIINTALINGGMTESDLKKLLKKYGIEMRKPGKLEVKLPDTVKTLKALKNILEQCGYSYEELIAENQFDLARPSRLQLLCEDLSKNITPQRRKKVLAKAGWNKELQQAMLRKKFGGTASVCKKYMLEAINAFRHGETYGNFQARRLQERAAEQQPQEKHLLLPPLTMKQDEEVTKNIVVFKAINETRKVLNAIIRRYGSPEYINIEVADDLGRSVSERMKLTKMMRDNEKARQKIAEKIIELGLRKEGEVKEGDIARYKLWQEQGGIDLYSGDPIAENAVLSSIYDIDHIVPFSLILDDTLQNKALVNMGANRQGKHQQVPLQYLQGEQKTKFLQNVNLLFKKGKISAKKYKYLLLPNLYNAEVLAEWKSRNINDTRYITRYIVNYLTANLKFANEDKKKHVYAVKGAITSRMRKKWLNKKSWGSVEKDRSNNLHHAADALVIANLTPAYVEIVSDNMKLNKIYREHHKQISFEYNDYLEKAVKKMQKYYGFNEAYARKLLEAKGRIPSIIKNLEREADIRLTDESMEFYQDKDASSFAEKAADFYRDDPQFAAGLRMPLVSYKQNKKFQGKITDDNPVKKAARKNTSLVKLDTLGNENILTASKYYCVELYETADGKNNLRGIRYADLKKQGKKLYLTAENPADYKRHKMYLFANDYIEVINQKGECKFKGFYKSVYAVNENRVYCNEGNTSKSINKTIAAKDIVKKYNIDILGEMGGEVKCSVPFMLLREKK

SEQ ID NO: 8365 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKNFNPNIFQLKYDGLSKKLSPEEIFAIIIHFCNHRGYKDFYEEDATTINEKERGKIKTALSNFEKIYKDNGYISVSEMILKDPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKINDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTKILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8366 - protein, 698 aa, unidentified
  REGION 1..698: note = Description of Unknown:uncultivated organism sequence
MNKPGNLKLKINDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTQILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLKLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8367 - protein, 1158 aa, unidentified
  REGION 1..1158: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLRNYLRYVHFMTDMEIRCASEASMNQILPVKVRGIDEKLTKAELLQVLIHACNHRGYKDFYEVTETDEAQSQEEEDEKINQAAADRLDRSFEESHCRTISEYICRYCTIPGTDRIDYRNRFYKNENRMIIRRKHVENEVSTILKKQREWYPELTDQKIKEIMEVIFSQRDFEDGPGYASDKAEYRRYTGFLESIGYCRFYPEERRGFRNTALGDVYAAINALSQYRYVHTDTGEAKLTKEAAAKMVSYILKQGSLTRTQAAKLLKPFGIAIYGSKDVDKTLAKSFRFLKEMKKIAEKCQVSWESLLSETDLTEYEEGKMSLLNQLGTVCSMYQTPHRKEEELKKLHAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMMLDTQSHAYEVDHIIPYSLILDNTLANKALVCGNENQAKGQQTPLMYLKGEKKEAFIERVKAEKKRTSHPISNKKYDYLMLATLYEKEILTGWKSRNINDTRYITKYVVGLIKNHLQFAGEKARVFGIRGHITSRFRKEWLGKNTWGSEEKCRANYLNHAADAIVLANLSKMDVEIAMDYEKLRQIRRHYGEMSIQYDHFLNHAAQRIAAFYPITEEAIRKQLVESKRTPSYVPNLESEVDLRLGNPEGETRSEEEYRAETEMYYEGAAFVVKPHLPYVSMKVEKKFRGEIADSNPIRFVEENGIFYKVSRKPVEELKATDLPKLYTSDGYLIEALEKAFTEGEKYLNNEDDKENKKDSPKKPIKKYMEKEHLDVFRTTNGQPVRKVSINEGKISSYYKKNIDDMNYSILGMPKYYCVEVYTNDKGQTKIWGLRFVDMIYYEGKLYLKDGVRPADYARHVMYIFKGEYIKVVTKGKVVCEGTYQNVEAINEKKLNIKIKNTNILQKPIPRIGNKTKVSKYAISLNGCKSGMVKEGETGYPCFAHCLLKKEND

SEQ ID NO: 8368 - protein, 564 aa, unidentified
  REGION 1..564: note = Description of Unknown:uncultivated organism sequence
MPSLTLKDDEDIVKNVVVFKAINETRKVINALIRKYGSFKYINILASDELGHSIQERKRIVKMQNKNRKETQNIRTKILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILFEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8369 - protein, 1046 aa, unidentified
  REGION 1..1046: note = Description of Unknown:uncultivated organism sequence
MMKKRKYGIGFDIGVGSVGFAVLSWTDEEDARIETLGARLFASGETADRKASLSQERRGYRSARRLIRRRKHRKDRVKFFLQKIGLISKEKLKAWQEVNGNQNVLRTRLQGLTEKLTPEEIADTVIHICNHRGYREFYEDENDDKDAGLIKTGLSDFEKCYHAGGYKSVADMLLHDEKFQTETEFTDYHNHKNGERYILIKREYVRDELLAILRRQQQFYPQLNDSNIEFLCDEIIFAQRDFETGPGNPNDEKRKFMGFLDTLGKCMFYKTEDRAFRSTVLADIYSLVNCLSQMSFVDTATGEIVLPEAAAEEIINTALINGGMTESDLKKLLKKYGIEMRKPGKLEVKLPDTVKTLKALKNILEQCGYSYEELIAENQFDLARPSRLQLLCEDLSKNITPQRRKKVLAKAGWNKELQQAMLRKKFGGTASVCKKYMLEAINAFRHGETYGNFQARRLQERAAEQQPQEKHLLLPPLTMKQDEEVTKNIVVFKAINETRKVLNAIIRRYGSPEYINIEVADDLGRSVSERMKLTKMMRDNEKARQKIAEKIIELGLRKEGEVKEGDIARYKLWQEQGGIDLYSGDPIAENAVLSGIYDIDHIVPFSLILDDTLQNKALVNMGANRQGKHQQVPLQYLQGEQKTKFLQNVNLLFKKGKISAKKYKYLLLPNLYNAEVLAEWKSRNINDTRYITRYIVNYLTANLKFANEDKKKHVYAVKGAITSRMRKKWLNKKSWGSVEKDRSNNLHHAADALVIANLTPAYVEIVSDNMKLNKIYREHHKQISFEYNDYLEKAVKKMQKYYGFNEAYARKLLEAKGRIPSIIKNLEREADIRLTDESMEFYQDKDASSFAEKAADFYRDDPQFAAGLQMPLVSYKQNKKFQGKITDDNPVKKAARKNTSLVKLDTLGNENILTASKYYCVELYETADGKNNLRGIRYADLKKQGKKLYLTAENPADYKRHKMYLFANDYIEVINQKGECKFKGFYKSVYAVNENRVYCNEGNTSKSINKTIAAKDIVKKYNIDILGEMGGEVKCSVPFMLLREKK

SEQ ID NO: 8370 - protein, 1157 aa, unidentified
  REGION 1..1157: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAEGQEEEDEKINQAAADRLDRSFEESHCRTISEYICRYCTIPRTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGETKLGQEAAAKMVSYIMKQGSLTRTQVAKLLKPLGIAIYGSKDVDKTLAKSFRFLKEMKKIAEKSQVSWESLLSETDLTKYEEGKTSLLNQLGTVCSMYQTPHRKEEELKKLHAKWEHAHLPPAFWNALKRHRFSGTSSVSYHHMADAIEAFLKGDKGDIYGNFQWNKQKQLDKKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLDEKEILTGWKSRNINDTRYITKYVVGLIKNHLQFAGGKARVFGIRGHITSRFRKEWLGKNTWGSEKKCRTNYLNHAADAIVLANLSKMDVEIAMDYEKLRQIQRHYGETSIQYDHFLNHAAQRIATFYPITEEAVRKQLVESERTPSYVPNLEKEVDLRLGNPEGETRSEEEYRAETEMYYEGAAFVVKPHLPYVSMKVEKKFRGEIADSNPIRLVEENGIFYQVRRKAVEELESKDLSELYTSDGYLIEALEKAFTEGEKYLNNEDDKENKKDSKKKPIKKYMEKEHIDVFRTTNGQPVRKVSLKGTPVSNYYKKSIDDTNYSILGVPKYYCVEVYTNSKGQTQIWGLRFVDMISYEGKLYLKDGVRPADYARHVMYLFPGEYIEVEKKGKIVYEGTYQNVYSINQGKLRIKVKNTNALEPISIGNKAGVLKYAISLNGCKSGVVKEGEAGYPCFAHCLSKKEND

SEQ ID NO: 8371 - protein, 1143 aa, unidentified
  REGION 1..1143: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVSTILKKQREWYPELTDQKIKEIMEVIFSQRDFEDGPGYASDKAEYRRYTGFLESIGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEHVHLPPAFWNALKRHRFSGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRTNYLNHAADAIVLANLSKMDVEIAMDYEKLRQIRRHYGEMSIQYDHFLNNAAQRIAAFYPITEEAIRKQLAESERTPSYVPNLEKEVDLRLGNPEGETRSEEEYRAKTEMYYEGAAFVVKPHLPYVSMKVERKFRGEIANSNPIRLVEENGIFYQVSRNAVEELESTDLSKLYTSDGYLIEALEKAFENKDVKTVKDYMEKEHLDVFRTTNGQPVRKVSIKGMPVSNYYKKSINETNYSILGVPKYYCVEVYTNSKGQTQIWGLRFVDMISYEGKLYLKDGVRPADYARHVMYLFPGEYIEVEKKGKIVYEGTYQNVFNINQGKLRVKVKNTNALKTISIGNKAGVFKYAISLNGCKSGVVKEGEAGYPCFAHCLSKKEND

SEQ ID NO: 8372 - protein, 1045 aa, unidentified
  REGION 1..1045: note = Description of Unknown:uncultivated organism sequence
MNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVSTILKKQREWYPELTDQKIKEIMEVIFSQRDFEDGPGYASDKAEYRRYTGFLESIGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEHVHLPPAFWNALKRHRFSGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRTNYLNHAADAIVLANLSKMDVEIAMDYEKLRQIRCHYGEMSIQYDHFLNNAAQRIAAFYPITEEAIRKQLAESERTPSYVPNLEKEVDLRLGNPEGETRSEEEYRAKTEMYYEGAAFVVKPHLPYVSMKVERKFRGEIANSNPIRLVEENGIFYQVSRNAVEELESTDLSKLYTSDGYLIEALEKAFENKDVKTVKDYMEKEHLDVFRTTNGQPVRKVSIKGMPVSNYYKKSINETNYSILGVPKYYCVEVYTNSKGQTQIWGLRFVDMISYEGKLYLKDGVRPADYARHVMYLFPGEYIEVEKKGKIVYEGTYQNVFNINQGKLRVKVKNTNALKTISIGNKAGVFKYAISLNGCKSGVVKEGEAGYPCFAHCLSKKEND

SEQ ID NO: 8373 - protein, 1071 aa, unidentified
  REGION 1..1071: note = Description of Unknown:uncultivated organism sequence
MTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGYASDKAEYRRYTGFLESIGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVAWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIQLYGSPAEIHVEVADDVARSYLERKRIQKMQRDHEKTRDAIKKKIAEILHCEESEVKGIQIERYKLYMEQEGKCLYSGRELNLEMVLDTQSHAYEVDHIIPYSLILDNTLANKALVCGNENQAKGQQTPLMYLKGEKKEAFIERVKAEKKRTSHPISNKKYDYLMLATLYEKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEESIRKQLVESKRTPSYVPNLEKEVDLRLGNPEGETRSEEEYRAKTEMYYEGAAFVVKPHLPYVSMKVERKFRGEIADSKPIRLVEENGIFYQVRRKAVEELESKDLSELYTSDGYLIEALEKAFTEGEKYLNNEDDKENKKDSKKKPIKKYMEKEHIDVFRTTNGQPVRKVSLKGTPVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLRIKVKNTNALKPISIGDKAGVFKYAISLNGCKSGVVKEGEAGYPCFAHCLLKKEND

SEQ ID NO: 8374 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQALIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIEKIMEVIFSQRDFEDGPGDASDKYRRYTGFLETLGYCRFYPEERRGFRNTALGDVYAAINALSQYRYVHTDTGEAKLTQEAAAKMVSYIMKQGSLTRTQAAKLLKPLGIAIYGSNDVDKTLAKSFRFLKEMKKIAEKCQVAWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGAPAEIHVEVADDVARSYLERKRIQKMQRDHEKTRGAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLFGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAVYPITEEAIRKQLVESKRTPSYVPNLEKEVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8375 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKNFNPNIFQLKYDGLSKKLSPEEIFAIIIHFCNHRGYKDFYEEDTTTINEKERGKIKTALSNFEKIYKDNGYISVSEMILKDPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKINDCLKALKILKNTLEKCGYDYTSLIKEEQFNLEQPSKLQKLCILLSKNITPKRRTLALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTKILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8376 - protein, 1159 aa, unidentified
  REGION 1..1159: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLRNYLRYVHFMTDMEIRCASEASMNQILPVKVRGIDEKLTKAELLQVLIHACNHRGYKDFYEVTETDEAQSQEEEDEKINQAAADRLDRSFEESHCRTISEYICRYCTIPGTDRIDYRNRFYKNENRMIIRRKHVENEVSTILKKQREWYPELTDQKIKEIMEVIFSQRDFEDGPGYASDKAEYRRYTGFLESIGYCRFYPEERRGFRNTVLGDVYAAINALSQYRYVHADTGEAKLTQEAAAKMVSYILKQGSLTRTQASKLLKPLGIAMYGSKDVDKTLVKSFRFLKEMKKIAEKCQVSWESLLSETDLTEYEEGKTSLLNQLGTVCSMYQTPHRKEEELKKLYAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCKESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEVAMDYEKLRQIRRHYGETSIQYDHFLKNAAQRIAAFYPITEEAIRKQLVESKRTPSYVPNLEKEVDLRLGNPEGETRSEEEYRAKTEMYYEGAAFVVKPHLPYVSMKVERKFRGEIAKSNPIRLVEGNGIFYQVSRKPVEELESKDLSELYTSDGYLIEALEKAFTEGEKYLNNEDDKENKKDSQKKPIKKYMEKEHIDVFRTTNGQPVRKVSLKGTPVSNYYKKSINETNYSILGVPKYYCVEVYTNSKGQTQIWGLRFVDMISYEGKLYLKDGVRPADYARHVMYLFPGEYIEVEKKGKIVYEGTYQNVFNINQGKLRIKVKNTNALKTISIGNKAGVFKYAISLNGRKSGVVKEGEAGYPCFAHCLSKKEND

SEQ ID NO: 8377 - protein, 1074 aa, unidentified
  REGION 1..1074: note = Description of Unknown:uncultivated organism sequence
MTDMEIRCASEVSMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVRTILKKQREWYPELTDQKIEKIMGVIFSQRDFEDGPGDASDKYRRYTGFLESLGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKSQVPWESLLSETDLTEYEEGKTSLLNQLGTVCSMYQTPHKKEEQLKKLHAKWEHAHLPPAFWNALKRHRFSGTSSVSYHHMADAIEAFLKGDIYGNFQWNKQKQLDEKQESQRERLLSVKVLMQDEDVKDNPVVLRSINETRKVLNCLIRLYGSPAEIHVEVADDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLFGKEAKEILKGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAFYPITEEAIRKQLVESERTPSYVPNLEKEVDLRLGNPEGETRSEEEYRAKTEMYYEGAAFVVKPHLPYVSMKVERKFRGEIADSNPIRLVEENGIFYKVSRKPVEELKATDLPKLYTSDGYLIEALEKAFTEGEKYLNNEDDKENKKDSPKKPIKKYMEKEHLDVFRTTNGQPVRKVSINEGKISSYYKKNIDDMNYSILGMPKYYCVEVYTNDKGQTKIWGLRFVDMIYYEGKLYLKDGVRPADYARHVMYIFKGEYIKVVTKGKVVCEGTYQNVEAINEKKLNIKIKNTNILQKPIPRIGNKTKVSKYAISLNGCKSGMVKEGETGYPCFAHCLLKKEND

SEQ ID NO: 8378 - protein, 797 aa, unidentified
  REGION 1..797: note = Description of Unknown:uncultivated organism sequence
MKSFRFLKEMKKIAEKCQVSWESLLSETDLTEYEEGKTSLLNQLGTVCSMYQTPHRKEEKLKKLRVKWEHVHLPPAFWNALKRHKFNGTSSVSYHHMADAIEAFLKGDIYGNFQWNKQKQLDEKQESQRERLLSAKILMQDEDVKDNPVVLRSINETRKVLNCLIRLYGSPAEIHVEVADDVARSYLERKRIQKMQRDHEKTRDAIKKKITEILHCTEAEVKGIQIERYKLYIEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYEKEILTGWKSRNINDTRYITKYVVGLIKNHLQFAGGKARVFGIRGHITSRFRKEWLGKNTWGSDEKCRANYLNHAADAIVLANLSKMDVEIAMDYEKLRQIRRHYGETSIQYDHFLKNAAKRIAAFYPITEEAIRKQLAESKRTPSYVPNLGREVDLRLGNPEGETRSEEEYRAETEMYYEGAAFVVKPHLPYVSMKVEKKFRGEIADSNPIRLVEENGIFYKVSRKPVEELESKHLSKLYTSDGYLIEAVEKAFENKDVKTVKDYMEKEHLDVFRTTNGQPVRKVSIKEGKISSYYKKNIDETNYSILGVPKYYCVEVYKDTKGKTRMWGIRYVDVISCEGKICLKDDIKLPKKYAKHLIYLFSGEYLEVTEDGKETYVGFYQSMKKATQSRINITINPGKKVKGNDGKEKIQWTKDIPITQKATVKKYVITLNGQKAGEVKEGEAGYPCFAHCLSKKEND

SEQ ID NO: 8379 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEKADGKDRKSQERRGFRGVRRVLRRRKHRKELLKNYIRYIQFMSDYEIRCACESPADKVLLTKVKGLDEKLSKAELLQALLHACNHRGYKDFYEVTETDEAESQEEEDEKINQAAADRLDRSFEESHCRTISEYICQYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALADVYAAINALSQYRYVHTDTGEAKLTQEAAAKMVSYILKQGSLTRTQAVKLLKPLGIAIYGSKDVDKTLAKSFRFLKEMKKIAEKCQVSWESLLSETDLTEYEEGKTSLLNQLGTVCSMYQTPHRKEEELKKLRAKWEHVHLPPAFWNALKRHRFSGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLFGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAVYPITEEAIRKQLVESKRTPSYVPNLEKEVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8380 - protein, 1157 aa, unidentified
  REGION 1..1157: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKKIMEVIFSQRDFEDGPGDASDKYCRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRGAIKKKIAEILHCEESEVKGSQIERYKLYMEQEGKCLYSGRELNLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRRHYGETSIQYDHFLNHAAQRIAAFYPITEEAIRKQLAESERTPSYVPSLESEVDLRLGNPEGETRSEEEYRAKTEMYYEGAAFVVKPHLPYVSMKVERKFRGEIADSKPIRLVEENGIFYQVRRKAVEELESKDLSELYTSDGYLIEALEKAFTEGEKYLNNEDDKENKKDSKKKPIKKYMEKEHIDVFRTTNGQLVRKVSLKGTPVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLRIKVKNTNALKPISIGDKAGVFKYAISLNGCKSGVVKEGEAGYPCFAHCLLKKEND

SEQ ID NO: 8381 - protein, 1156 aa, unidentified
  REGION 1..1156: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLRNYLRYVHFMTDMEIRCASEASMNQILPVKVRGIDEKLTKAELLQVLIHACNHRGYKDFYEVTETDEAQSQEEEDEKINQAAADRLDRSFEESHCRTISEYICRYCTIPGTDRIDYRNRFYKNENRMIIRRKHVENEVSTILKKQREWYPELTDQKIKEIMEVIFSQRDFEDGPGYASDKAEYRRYTGFLESIGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRGAIKKKIAEILHCEESEVKGSQIERYKLYMEQEGKCLYSGRELNLEMVLDTQSHAYEVDHIIPYSLILDNTLANKALVCGNENQAKGRQTPLMYLKGEKKEAFIERVKAEKKRTNHPISNKKYDYLMLATLYGKEAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKRTPSYVPNLEKEVDLRLGNPEGETRSEEEYRAKTEMYYEGVAFVVKPHLPYVSMKVERKFRGEIAKSNPIRLVEGNGIFYQVSRKPVEELESKDLSELYTSDGYLIEALEKAFTEGVNNEDDKENKKDSKKKPIKKYMEKEHIDVFRTTNGQPVRKVSLKGTPVSNYYKKSINETNYSILGVPKYYCVEVYTNSEGQTQIWGLRFVDMISYEGKLYLKDGVRPADYARHVMYLFPGEYIEVEKKGKIVYEGTYQNVFNINQGKLRIKVKNTNALKTISIGNKAGVFKYAISLNGRKSGVVKEGEAGYPCFAHCLSKKEND

SEQ ID NO: 8382 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRSVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCIIPGTDRIDYRNRFYKNENRMIIRRKHVENEVCMILKKQREWYPELTDQKIEKIMGVIFSQRDFEDGPGDVSDKYRRYTGFLESLGYCRFYPEERRGFRNTALGDVYAAINALSQYRYVHTDTGEAKLSQEVAAKMVSYIMKQGSLTRTQAAKLLKPLGIAIYGSKDVDKTLAKSFRFLKEMKKIAEKSQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKCTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8383 - protein, 824 aa, unidentified
  REGION 1..824: note = Description of Unknown:uncultivated organism sequence
MVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFWNALKRHRFSGTSSVSYRHMADAIEAFLKGDIYGNFQWNKQKQLDEKQESQRERLLSAKILMQDEDVKDNPVVLRSINETRKVLNCLIRLYGSPAEIHVEVADDVACSYLERKRIQKMQRDHEKTRDAIKKKIAEILHCAESEVKGIQIERYKLYMEQEGKCLYSGRELDLEMVLDTQSHAYEVDHIIPYSLILDNTLANKALVCGNENQAKGQQIPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKCTPSYVPNLGREVDLRLGNPEGETRSEEEYRTETEMYYEGAAFVVKPHLPYVSMKVERKFRGEIADSNPIRLVEENGIQYKISRSKVEELKREQLSKLYTSDGYLIEALEKAFENKDVKTVKDYMEKKHLDVFRTTNGQPVRKVSIKGMPVSNYYKKRINETNYSILGVPKYYCVEVYTNDKGQTKIWGLRFVDMVSYERKLYLKDGVRPADYARHVMYLFPGEYIEVAKNGKIVYEGIYQNVYAINEGRLRIKVKNTNALKPIRIGNKIEVFKYTITLNGCKSGEVQEGEAGYPCFAHCLSKKEND

SEQ ID NO: 8384 - protein, 903 aa, unidentified
  REGION 1..903: note = Description of Unknown:uncultivated organism sequence
MIFSQRDFEDGPGDASDKYRRYTGFLESLGYCRFYPEERRGFRNTALGDVYAAINALSQYRYVHTDTGEAKLTQEAAAKMVSYILKQGSLTRTQAVKLLKPLGIAIYGSKDVDKTLAKSFRFLKEMKKIAEKCQVSWESLLSETDLTEYEEGKTSLLNQLGTVCSMYQTPHRKEEELKKLRAKWEHVHLPPAFWNALKRHRFSGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMFATLFGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAVYPITEEAIRKQLVESKRTPSYVPNLEKEVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8385 - protein, 1141 aa, unidentified
  REGION 1..1141: note = Description of Unknown:uncultivated organism sequence
MEKRQYRFAFDIGIGSCGWAVVSENETGNRRIEDAGSRNFDSGEMKEGKDRKSQERRGFRSVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCMILKKQREWYPELTDQKIEKIMGVIFSQRDFEDGPGDVSDKYRRYTGFLESLGYCRFYPEERRGFRNTALGDVYAAINALSQYRYVHTDTGEAKLSQEVAAKMVSYIMKQGSLTRTQAAKLLKPLGIAIYGSKDVDKTLAKSFRFLKEMKKIAEKSQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKCTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYSCFAHCLLKKEND

SEQ ID NO: 8386 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEKADGKDRKSQERRGFRSVRRVLRRRKHRKELLKNYIRYIQFMSDYEIRCACESPADKVLLTKVKGLDEKLSKAELLQALLHACNHRGYKDFYEVTETDEAESQEEEDEKINQAAADRLDRSFEESYCRTISEYICRYCTIPGTDRIDYRNRFYKNENRMIIRRKHVENEVRTILKKQREWYPELTDQKIEKIMGVIFSQRDFEDGPGDASDKYRRYTGFLESLGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCAESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAVYPITEEAIRKQLVESKRTPSYVPNLEKEVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8387 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQKEEDEKINQAAADRLDRSFEESHCRTISEYICRYCTIPGTDRIDYRNRFYKNENCMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGETKLSQEAAAKMVSYIMKQGSLTRTQAAKLVKPLGIAIYGSKDVDKTLAKSFRFLKEMKKIAEKTQVSWESLLSETDLTEYEEGKTSLLNQLGTVCSMYQTTHRKEEELKKLHAKWEHVHLPLAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8388 - protein, 1062 aa, unidentified
  REGION 1..1062: note = Description of Unknown:uncultivated organism sequence
MKRKYGIGLDIGIGSCGWCIISWELPDKSDARIEDLGVRLFDSGEISYEATAQKNRKNQERRNYRSVRRLLRRRKHRKERVKRFLQKIGLINCYELQRWQELNGNQNIFAVRFKGLSEKLTPEEIADCIIHICNHRGYRDFYDDEQDDDEAQITKQRLLNFETIYREGKYVSVADMILHDDAFTTGTDFPDYHNHKLKPGEDISKSERYILIARNNVKKELLDILNKQQEFYPKELTEKNIDFIVNEIVFAQRDFETGPGKEGDSTRKFMSFLDSLGNCRFYKDERRAFRSTIIADIYALINSLSQFTYVDIKTGEVILKTEASKAIINMALENGGITEADIKKILKHYDLEWVKPSGLSEKIPDTVKTLKTLKRILEQNGYSYQELIKEEQFDLEYPSRLHALCICLSENITPARRKKALSKLGWSEKLQDALVRQKFGGTASVCEQYMLDAIKAFCDGEAYGNFQARILKNIELQNANVTKHVLLPVITKVFDEDITKNVVVFKSINEVRKVINALVRKYGSPEYINVEVADELGKSFMQRKKIEKENKNNRKNTEEIASKLVELGLRKEGEVKSGDILKYRLWLSQGGIDLYTGEIIDTNQILSYQYEVDHIVPFSLILDDTIHNKALVNLGANRAQKAQQVPLEYLQGLQRDTFLKNVNLLFKKKKISQKKYQYLMMESLGGEKAQEILAEWKSRNINDTRYITRYIVNYLTNNLQFTGDQDKKHVFGIKGALTSRLRKIWLKGTAWGSDEKSRENNLHHAADAVVIANMTPACIELASDNIKLNSIFYSNRKRRNTEYDVYLEKAKRKMEKYYGYAPEYTEMLLTKHGRVPSIIRRITEETFIRLTDPTVDGYVNVTKENFECNVKAFYADNPELAGGITMPLVSYKQEKKYQGKMTKDGAVRKQEADDKLLLKEDAKGNITALPANLYYCIEVYKDVQGATQLRGVRFVDLVKRDKKLWLRYAYPEDYKSHVMYLFANDYIRIFNSKGVVKFEGYYKSVKSIFRNYIYAKNNNSNSAVAIGIAKKDTVKKFDVDILGKIGGEVQCSAPFMLLPENV

SEQ ID NO: 8389 - protein, 1162 aa, unidentified
  REGION 1..1162: note = Description of Unknown:uncultivated organism sequence
MEKRQYRFAFDIGIGSCGWAVVSENETGNRRIEDAGSRIFDSGEMKEGKDRKSQERRGFRGVRRVLRRRSHRKYRLKNYLRYVHFMTDMEIRCASEVSMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVSTILKKQREWYPELTDQKIKEIMGVIFSQRDFEDGPGYASDKYRRYTGFLESLGYCRFYPEERRGFRNTALGDVYAAINALSQYRYVHTDTGETKLGQEAAAKMVSYIMKQGSLTRTQVAKLLKPLGIAIYGSKDVDKTLAKSFRFLKEMKKIAEKSQVSWESLLSETDLTKYEEGKTSLLNQLGTVCSMYQTPHRKEEELKKLHAKWEHAHLPPDFWNALKRHRFSGTSSVSYHHMADAIEAFLKGDKGDIYGNFQWNKQKQLDKKQESQRERLLSAKVLMQDEDVKDNPVVLRSINETRKVLNCLIRIYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILKGWKSRNINDTRYITKYVVGLIKNHLQFAGGKARVFGIRGHITSRFRKEWLGKNTWGSEKKCRTNYLNHAADAIVLANLSKMDVEIAMDYEKLRQIQRHYGETSIQYDHFLNHAAQRIATFYPITEEAVRKQLVESERTPSYVPNLEKEVDLRLGNPEGETRSEEEYRAKTEMYYEGAAFVVKPHLPYVSMKVERKFRGEIADSNPIRLVEENGIFYKVSRKPVEELKATDLPKLYTSDGYLIEALEKAFTEGEKYLNNEDDKENKKDSPKKPIKKYMEKEHLDVFRTTNGQPVRKVSINEGKISSYYKKNIDDMNYSILGMPKYYCVEVYTNDKGQTKIWGLRFVDMIYYEGKLYLKDGVRPADYARHVMYIFKGEYIKVVTKGKVVCEGTYQNVEAINEKKLNIKIKNTNILQKPIPRIGNKTKVSKYAISLNGCKSGMVKEGETGYPCFAHCLLKKEND

SEQ ID NO: 8390 - protein, 1146 aa, unidentified
  REGION 1..1146: note = Description of Unknown:uncultivated organism sequence
MEKSKRIYRLGLDIGIGSVGWAVVSEKDGIGRIENFGTRIFDSGELNKVKRRTSQERRGFRSVRRVQRRRKFRKQSVKLFLTEIGFLTNDEIKKAEENFTADIIPLKVRAIKEKISKSELLNCLIHTCNHRGYKDFYEIDEDEIEDEDEDEEQGNIAAASSFDKNFRKSGCTIVSEYLMKNYKVSDGKINFRNKDHKEDERIIIRRKHMEKEIETILEKQSEFYNELTEENRKNIFEIIFRQRAFEDGPGQAGNSYRRYKGFIDSIGRCRFYPEENRGFRNTVIGDLFAGINALSQYRYVNKETGEVGLTPEIAKILIDEILKKGNLNNTEAEKILKKENIEIYGSEDVDKTLTSSFKYIKVIKKITDEAKINWNTLISENQFEYEENKMSLLNKLGCILSCWQTPSKRSGKLKEFIKNHPKGNLFNDEVLEKLMKKKISGTSNASYHYMSEAVQAFLEGKIYGDFQWEREEKLLNKQIENNNIKVPVSALKNNVDIADNPVVYRGINETRKIVNAIIDVYGMPEYINVEFAKDVAKSFDARKKEGERQKENIKKNEKIVKEIAKKLGIEETDVRGTQIERYKLYKEQECKCMYSGEPLDLRKVLSDKDRSYEVDHIIPYSLILDDTLANKALVLGSENQIKKQRVPLMYLTGKKKEDFLKNVEAFSTRKANPISAKKREYLLMPTIYGKEIQEKLKDWKSRNINDTRYITKFMIALLKSTLIKENENGEKLPHVYGIRGHITSRFRKKWLGKNWGNEEKPRESYLNHAADAVVIACLTQDDVRITMEYEKLRQMYRHKKWMNNDNYREALFRVAGQLKMFSKKSKEEIVDILLDRNFSTSIIPNLYKEVDVRFGPVEGDKRTEEEFRIDINNYYSGTEDFIVKPHLSHVSKKQTKRFRGAFADSNPIRLIDEEGKKRKILRKSIKVIKRKDLKNLHTNDTSLIEALNKVFEGKKDGYTVEKYMKENNLKEFCTAGGQKVYKVSVRCPKVSNYYKKQIDGKNFSILGIRKYYCAEVYEDNKGKTRTWGLRYVDMVKRECKLYLKDNVLPKDYVKHVTYLFKGDYIVVYKKDEKIFEGYYKSVEAINNNRFNGFGGNNSKSIGLSIGSNCRVEKYQIDLLGRKCGRIDESRGDYPCFVPLSSKKKKS

SEQ ID NO: 8391 - protein, 1157 aa, unidentified
  REGION 1..1157: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRGAIKKKIAEILHCEESEVKGSQIERYKLYMEQEGKCLYSGRELNLEMVLDTQSHAYEVDHIIPYSLILDNTLANKALVCGNENQAKGQQTPLMYLKGEKKEAFIERVKAEKKRTNHPISNKKYDYLMLATLYGKEAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKRTPSYVPNLEKEVDLRLGNPEGETRSEEEYRAKTEMYYEGAAFVVKPHLPYVSMKVERKFRGEIAKSNPIRLVEGNGIFYQVSRKPVEELESKDLSELYTSDGYLIEALEKAFTEGEKYLNNEDDKENKKDSPKKPIKKYMEKEHIDVFRTTNGQPVRKVSLKGTPVSNYYKKSINETNYSILGVPKYYCVEVYTNSKGQTQIWGLRFVDMISYEGKLYLKDGVRPADYARHVMYLFPGEYIEVEKKGKIVYEGTYQNVFNINQGKLRIKVKNTNALKTISIGNKAGVFKYAISLNGRKSGVVKEGEAGYPCFAHCLSKKEND

SEQ ID NO: 8392 - protein, 1143 aa, unidentified
  REGION 1..1143: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEATETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGYASDKAEYRRYTGFLESIGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCAESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIQRHYGEMSIQYDHFLNHAAQRIAAFYPITEEAIRKQLVESKCTPSYVPNLGREVDLRLGNPEGETRSEEEYRAKTEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYRNVYNINQGVLSIKVKNTNALKPISIGNKAGVFKYAISLNGRKSGMVKEGEAGYPCFAHCLSKKEND

SEQ ID NO: 8393 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILQKQREWYPELTDQKIKEIMERIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLPKMDVEIAMDYEKLRQIRRHYGETSIQYDHFLKNAAQRIAAFYPITEEAIRKQLVESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYLKDGVRPADYARHMMYLFPGEYIEVEKKGKIVYEGTYQNVYSINQGVLRIKVKNTNALKPISIGNKAGVFKYAISLNGCKSGAVKEGEAGYPCFAHCLSKKEND

SEQ ID NO: 8394 - protein, 1056 aa, unidentified
  REGION 1..1056: note = Description of Unknown:uncultivated organism sequence
MTDMEIRCASEASMNQILPVKVRGIDEKLTKAELLQVLIHACNHRGYKDFYEVTEIDEAESQKEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGETKLSQEAAVKMVSYIMKQGSLTRTQAAKLVKPLGIAIYGSKDVDKTLAKSFRFLKEMKKIAEKTQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQNHAYEVDHIIPYSLILDNTLANKALVCGNENQAKGQQTPLMYLKGEKKEAFIERVKAEKKRTSHPISNKKYDYLMLATLYGKETKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAFYPITEEAIRKQLVESKRTLSYVPNLGREVDLRLGNPEGETRSEEEYRAETEMYYEGAAFVVKPHLPYVSMKVERKFRGEIADSNPIRLVEENGIQYKISRSKVEELKREQLPKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYLKDGVRPADYARHMMYLFPGEYIEVEKKGKIVYEGTYQNVYSINQGVLRIKVKNTNALKSISIGNKAGVFKYAISLNGCKSGAVKEGEAGYPCFAHCLSKKEND

SEQ ID NO: 8395 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRKHRKELLKNYIRYIQFMSDYEIRCACESPADKVLLTKVKGLDEKLSKAELLQALLHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKKIMEVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQNHAYEVDHIIPYSLILDNTLANKALVCGNENQAKGQQTPLMYLKGEKKEAFIERVKAEKKRTSHPISNKKYDYLMLATLYGKETKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVKPHLPYVSMKVERKFRGEIADSNPIRLVEENGIQYKISRSKVEELKREQLPKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYLKDGVRPADYARHMMYLFPGEYIEVEKKGKIVYEGTYQNVYSINQGVLRIKVKNTNALKPISIGNKAGVFKYAISLNGCKSGAVKEGEAGYPCFAHCLSKKEND

SEQ ID NO: 8396 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRKHRKELLKNYIRYIQFMSDYEIRCACESPADKVLLTKVKGLDEKLSKAELLQALLHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGEAKLTQEAAAKMVSYILKQGSLTRTQAAKLLKPLGIAIYGSKDVDKTLAKSFRFLKEMRKIAEKCQVSWESLLSETDLTEYEEGKTSLLNQLGTVCSMYQTTHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNYLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLTGEKKAAFIERVKAEKGRTSHPISNKKYDYLMLSTLYGEEAKGILAGWKSRNINDTRYITKYIVGLIKNHLQFAGEKPRVFGIRGHITSRFRKEWLGKNTWGSEEKCRENYLNHAADAIVLANLSKMDVEIAMDYEKLHQIQRHYGETSIQYDHFLKNAAQRIAAFYPITEEAIRKQLVESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGMPVSNYYKKSINETNYSILGMPKYYCVEVYTNSKGQTQIWGLRFVDMISYEGKLYLKDGVRPADYARHVMYLFPGEYIEIEKKGKIVYEGTYQNVYNINEGRLRVKVKNTNALKPISIGNKVGVFKYAISLNGYKSGVVKEGEAGYPCFAHCLSKKEND

SEQ ID NO: 8397 - protein, 1143 aa, unidentified
  REGION 1..1143: note = Description of Unknown:uncultivated organism sequence
MEKRQYRFAFDIGIGSCGWAVVSENETGNRRIEDAGSRIFDSGEMKEGKDRKSQERRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCAIPGTDRIDYRNRFYKNENRMIIRRKHVENEVCTILKKQREWYPELTDQKIKEIMEVIFSQRDFEDGPGYASDKAEYRRYTGFLESIGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVAWESLLSETDLTEYEEGKTSLLNQLGTVCSMYQTPHKKEEQLKKLHAKWEHAHLPPAFWNALKRHRFSGTSSVSYHHMADAIEAFLKGDIYGNFQWNKQKQLDEKQESQRERLLSAKVLMQDEDVKDNPVVLRSINETRKGLNCLIRLYGSPAEIHVEVADDVARSYLERKRIQKMQRDHEKTRDAIKKKIAEILHCAEAEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAFYPITEEAIRKQLAESERTPSYVPSLGREVDLRLGNPEGETRSEEEYRAETEMYYEGAAFVVKPHLPYVSMKVEKKFRGEIADSNPIRLVEENGIQYKISRSKVEELKREQLSKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLRIKVKNTNALKPISIGDKAGVFKYAISLNGCKSGVVKEGEAGYPCFAHCLLKKEND

SEQ ID NO: 8398 - protein, 1146 aa, unidentified
  REGION 1..1146: note = Description of Unknown:uncultivated organism sequence
MEKSKRIYRLGLDIGIGSVGWAVVSEKDGIGRIENFGTRIFDSGELNKVKRRTSQERRGFRSVRRVQRRRKFRKQSVKLFLTEIGFLTNDEIKKAEENFTADIIPLKVRAIKEKISKSELLNCLIHTCNHRGYKDFYEIDEDEIEDEDEDEEQGNIAAASSFDKNFRKSGCTIVSEYLMKNYKVSDGKINFRNKDHKEDERIIIRRKHMEKEIETILEKQSEFYNELTEENRKNIFEIIFRQRAFEDGPGQAGNSYRRYKGFIDSIGRCRFYPEENRGFRNTVIGDLFAGINALSQYRYVNKETGEVGLTPEIAKILIDEILKKGNLNNTEAEKILKKENIEIYGSEDVDKTLTSSFKYIKVIKKITDEAKINWNTLISENQFEYEENKMSLLNKLGCILSCWQTPSKRSGKLKEFIKNHPKGNLFNDEVLEKLMKKKISGTSNASYHYMSEAVQAFLEGKIYGDFQWEREEKLLNKQIENNNIKVPVSALKNNVDIADNPVVYRGINETRKIVNAIIDVYGMPEYINVEFAKDVAKSFDARKKEGERQKENIKKNEKIVKEIAKKLGIEETDVRGTQIERYKLYKEQECKCMYSGEPLDLRKVLSDKDRSYEVDHIIPYSLILDDTLANKALVLGSENQIKKQRVPLMYLTGKKKEDFLKNVEAFSTRKANPISAKKREYLLMPTIYGKEIQEKLKDWKSRNINDTRYITKFMIALLKSTLIKENENGEKLPHVYGIRGHITSRFRKKWLGKNWGNEEKPRESYLNHAADAVVIACLTQDDVRITMEYEKLRQMYRHKKWMNNDNYREALFRVAGQLKMFSKKSKEEIVDILLDRNFSTSIIPNLYKEVDVRFGPVEGDKRTEEEFRIDINNYYSGTEDFIVKPHLSHVSKKQTKRFRGAVADSNPIRLIDEEGEKIKISRKSIKDIKRKDLKNLHTNDTSLIEALNKVFEGKKDGYTVEKYMKENNLKEFCTAGGQKVYKVSVRCPKVSNYYKKQIDGKNFSILGIRKYYCAEVYEDNKGKTRTWGLRYVDMVKRECKLYLKDNVLPKDYVKHVTYLFKGDYIVVYKKDEKIFEGYYKSVEAINNNRFNGFGGNNSKSIGLSIGSNCRVEKYQIDLLGRKCGRIDESRGDYPCFVPLSSKKKKS

SEQ ID NO: 8399 - protein, 1157 aa, unidentified
  REGION 1..1157: note = Description of Unknown:uncultivated organism sequence
MEKRQYRFAFDIGIGSCGWAVVSENETGNRRIEDAGSRIFDSGEKADGKDRKSQERRGFRSVRRVLRRRSHRKYRLKNYLRYVHFMTDMEIRCASEASMNQILPVKVRGIDEKLTKAELLQVLIHACNHRGYKDFYEVTETDEAESQEEDDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESLGYCRFYPEERRGFRNTALGDVYAAINALSQYRYVHTDTGETKLTQEAAAKMVSYILKQGSLTRTQAAKLLKPLGIAIYGSKDVDKTLAKSFRFLKEMKKIAEKCQVSWESLLSETDLTEYEEGKTSLLNQLGTVCSMYQTPHRKEEQLKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIQRHYGETSIQYDHFLNHAAQRIAAFYPITEEAIRKQLAESERTPSYVPSLESEVDLRLGNPEGETRSEEEYRAKTEMYYEGAAFVVKPHLPYVSMKVEKKFRGEIADSNPIRLVEENGIFYQVRRKAVEELESKDLSELYTSDGYLIEALEKAFTEGEKYLNNEDDKENKKDSPKKPIKKYMEKEHIDVFRTTNGQPVRKVSLKGTPVSNYYKKNIDDTNYSILGVPKYYCVEVYTNSKGQTQIWGLRFVDMISYEGKLYLKDGVRPADYARHVMYLFPGEYIEVEKKGKIVYEGTYQNVFNINQGKLRIKVKNTNALKTISIGNKAGVFKYAISLNGRKSGVVKEGEAGYPCFAHCLSKKEND

SEQ ID NO: 8400 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKIFNPNIFQLKYDGLSKKLSPEEIFAIIIHFCNHRGYKDFYEEDTTTTNEKERGKIKTALSNFEKIYKDNGYISVSEMILKDPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKIDDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTQILELGLKKEDEITTQDIQRYKLYQQQNGMDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8401 - protein, 1143 aa, unidentified
  REGION 1..1143: note = Description of Unknown:uncultivated organism sequence
MEKRQYRFAFDIGIGSCGWAVVSENETGNRRIEDAGSRIFDSGEKADGKDRKSQERRGFRGVRRVLRRRSHRKYRLKNYLRYVHFMTDMEIRCASEASMNQILLVKVRGIDEKLTKAELLQVLIHACNHRGYKDFYEVTETDEAQSQEEEDEKINQAAADRLDRSFEESHCRTISEYICQYCTIPGTDRIDYRNRFYKNENRMIIRRKHVENEVCTILKKQREWYPELTDQKIEKIMERIFSQRDFEDGPGYASDKDRYRRYTGFLESIGYCRFYPEERRGFRNTALGDVYAAINALSQYRYVHTDTGEAKLTQEAAEKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHKKEEELKKLHAKWEHAHLPPAFWNALKRHRFSGTSGVSYHHMVDAIEAFLAGDIYGNFQWNKQEVLDEKQESQKERLLSAKVLMQDEDVKDNPVVLRSINETRKVLNCLIRLYGSPAEIHVEVADDVARSYPERKRIQKMQRDHEKTRGAIKKKIAEILHCAESEVKGSQIERYKLYMEQGKKCLYSGRELDLEMVLDTKSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLAESERTPSYVPSLESEVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYSCFAHCLLKKEND

SEQ ID NO: 8402 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEKADGKDRKSQERRGFRSVRRVLRRRSHRKYRLKNYLRYVHFMTDMEIRCASEASMNQILPVKVRGIDEKLTKAELLQVLIHACNHRGYKDFYEVTETDEAESQEEDDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVANDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRHHYGEMSIQYDHFLNHAAQRIAAFYPITEEAIRKQLAESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8403 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRSHRKYRLKNYLRYVHFMTDREIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCMILKKQREWYPELTDQKIERIMGVIFSQRDFEDGPGDASDKYRRYTGFLESLGYCRFYPEERRGFRNTALGDVYAAINALSQYRYVHTDTGEAKLTQEAAAKMVSYILKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPVFGNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCAESEVKGIQIERYKLYMEQEGKCLYSGRELDLEMVLDTQSHAYEVDHIIPYSLILDNTLANKALVRGNKNQAKGQQTPLMYLKGEKKEAFIERVKTEKKRTSHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKCTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYSCFAHCLLKKEND

SEQ ID NO: 8404 - protein, 1173 aa, unidentified
  REGION 1..1173: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIEKIMEVIFSQRDFEDGPGDASDKYRRYTGFLESLGYCRFYPEERRGFRNTALGDVYAAINALSQYRYVHTDTGEAKLSQEAAAKMVSYIMKQGSLTRTQAAKLLKPFGIAIYGSKDVDKTLAKSFRFLKEMKKIAEKCQVSWESLLSETDLTEYEEGKTSLLNQLGTVCSMYQTPHKKEEQLKKLHAKWEHAHLPPAFWNALKRHRFSGTSRVSYHHMADAIEAFLKRDKGDIYGNFQWNKQKQLDKKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRALNLEMVLDTKSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLAESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFTEGEKYLNNEDDKENKKDSPKKPIKKYMEKEHIDVFRTTNGQPVRKVSLKGTPVSNYYKKSINETNYSILGVPKYYCVEVYKDTKGKTRIWGIRYVDVISCEGKICLKDDIKLPKKYAKHLIYLFSGEYFEVTEDGKETYVGFYQSVKAATQSKINITINPGKKGKGNDGKEKIQWTKVIPITQKATVKKYVITLNGQKAGEVKEGEAGYPCFAHCLSRKEND

SEQ ID NO: 8405 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYYTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCAESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSEEKCRANYLNHAADAIVLANLSKMDVEIAMDYEKLRQIRRHYGETSIQYDHFLNHAAQRIAAFYPITEEAIRKQLAESKCTPSYVPNLEKEVDLRLGNPEGETRSEEEYRAKTEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8406 - protein, 1154 aa, unidentified
  REGION 1..1154: note = Description of Unknown:uncultivated organism sequence
MEKRQYRFAFDIGIGSCGWAVVSENETGNRRIEDAGSRIFDSGEMKEGKDRKSQERRGFRSVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHAHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCAESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKSHLQFAGEKARVFGIRGHITSRFRKEWLGKNTWGSDEKCRTNYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVKPHLPYVSMKVEKKFRGEIADSNPIRLVEENGIQYKISRSKVEELKREQLSKLYTSDGYLIEALEKAFENKDVKTVKDYMEKEHLDVFRTTNGQPVRKVSIKGMSVSNYYKKSINETNYSILGVPKYYCVEVYKDTKGKTRMWGIRYVDVISCEGKICLKDDIKLPKKYAKHLIYLFSGEYLEVTEDGKETYVGFYQSVKAATQSKINITINPGKKGKGNDGKEKIQWTKVIPITQKATVKKYVITLNGQKAGEVKEGEAGYPCFAHCLSKKEND

SEQ ID NO: 8407 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCVSEASMNQILPVKVRGIDEKLTKAELLQVLIHACNHRGYKDFYEVTETDEAESLEEEDEKINQAAADRLDRLFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGEAKLTQEAAAKMVSYILKQGRLTRTQAAKLLKPLGIAIYGSKDVDKTLAKSFRFLKEMRKIAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKILMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVRSHLPYVSMKVERKFRGEIADSNPIRLVEENGIQYKISRSKVEELKREQLPKLYTSDGYLIEALEKAFENKDVKTVKDYMEKEHLDVFRTTNGQPVRKVSIKGMPVSNYYKKRINETNYSILGVPKYYCVEVYTNSKGQTKIWGLRFVDMISYEGKLYLKDGVRPADYARHGMYLFPGEYIEVEKRGKIVYEGTYQNVYSINQGVLRIKVKNTNALKPISIGNKAGVFKYAISLNGCKSGAVKEGEAGYPCFAHCLSKKEND

SEQ ID NO: 8408 - protein, 1151 aa, unidentified
  REGION 1..1151: note = Description of Unknown:uncultivated organism sequence
MEKRQYRFAFDIGIGSCGWAVVSENETGNRRIEDAGSRIFDSGEKADGKDRKSQERRGFRGVRRVLRRRKHRKELLKNYIRYIQFMSDYEIRCACESPADKVLLTKVKGLDEKLSKAELLQALLHACNHRGYKDFYEVTETDEAESQEEEDEKINQAAADRLDRSFEESHCRTISEYICQYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYCYVHTDTGEAKLTQEAAAKMVSYIMKQGSLTRTQAAKLLKPLGIAIYGSKDVDKTLVKSFRFLKEMKKIAEKCQVSWESLLSETDLTEYEEGKTSLLNQLGTVCSMYQTPHRKEEKLKKLRVKWEHVHLPPAFWNALKRHKFNGTSSVSYHHMADAIEAFLKGDIYGNFQWNKQKQLDEKQESQRERLLSAKILMQDEDVKDNPVVLRSINETRKVLNCLIRLYGSPAEIHVEVADDVARSYLERKRIQKMQRDHEKTRDAIKKKITEILHCTEAEVKGIQIERYKLYIEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYEKEILTGWKSRNINDTRYITKYVVGLIKNHLQFAGGKARVFGIRGHITSRFRKEWLGKNTWGSDEKCRANYLNHAADAIVLANLSKMDVEIAMDYEKLRQIRRHYGETSIQYDHFLKNAAKRIAAFYPITEEAIRKQLAESKRTPSYVPNLGREVDLRLGNPEGETRSEEEYRAETEMYYEGAAFVVKPHLPYVSMKVEKKFRGEIADSNPIRLVEENGIFYKVSRKPVEELESKHLSKLYTSDGYLIEAVEKAFENKDVKTVKDYMEKEHLDVFRTTNGQPVRKVSIKEGKISSYYKKNIDETNYSILGVPKYYCVEVYKDTKGKTRMWGIRYVDVISCEGKICLKDDIKLPKKYAKHLIYLFSGEYLEVTEDGKETYVGFYQSMKKATQSRINITINPGKKVKGNDGKEKIQWTKDIPITQKATVKKYVITLNGQKAGEVKEGEAGYPCFAHCLSKKEND

SEQ ID NO: 8409 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVWTILKKQREWYPELTDQKIEKIMGVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEQVHFPPAFWNALKRHKFNGTSSVSYHHMVDAIEAFLKGDIYGNFQWNKQKQLDEKQESQRERLLSAKILMQDEDVKDNPVVLRSINETRKVLNCLIRLYGSPAEIHVEVADDVARSYLERKRIQKIQRDHEKTRDAIKKKIAEILHCTESEVKGIQIERYKLYMEQEGKCLYSGRELDLEMVLDTQSHAYEVDHIIPCSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRHHYGEMSIQYDHFLNHAAQRIAAFYPITEEAIRKQLAESKRTPSYVPNLGREVDLRLGNPEGETRSEEEYRAKTEMYYEGAAFVVKPHLPYVSMKVERKFRGEIADSNPIRLVEENGIQYKISRSKVEELKREQLPKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYLKDGVRPADYARHVMYLFPGEYIEVEKKGKIVYEGTYQNVYSINQGVLRIKVKNTNALKPISIGNKAGVFKYAISLNGCKSGAVKEGEAGYPCFAHCLSKKEND

SEQ ID NO: 8410 - protein, 1170 aa, unidentified
  REGION 1..1170: note = Description of Unknown:uncultivated organism sequence
MEKRQYRFAFDIGIGSCGWAVVSENETGNRRIEDAGSRIFDSGEMKEGKDRKSQERRGFRSVRRVLRRRSHRKYRLKNYLRYVHFMTDMEIRCASEASMNQILPVKVRGIDEKLTKAELLQVLIHACNHRGYKDFYEVTETDEAQSQEEEDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESIGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKSQVSWESLLSETDLTKYEEGKTSLLNQLGTVCSMYQTPHRKEEELKKLHAKWEHAHLPPAFWNALKRHRFSGTSSVSYHHMADAIEAFLKGDKGDIYGNFQWNKQKQLDKKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLDEKEILTGWKSRNINDTRYITKYVVGLIKNHLQFAGGKARVFGIRGHITSRFRKEWLGKNTWGSEKKCRTNYLNHAADAIVLANLSKMDVEIAMDYEKLRQIQRHYGETSIQYDHFLNHAAQRIATFYPITEEAVRKQLVESERTPSYVPNLEKEVDLRLGNPEGETRSEEEYRAETEMYYEGAAFVVKPHLPYVSMKVEKKFRGEIADSNPIRLVEENGIFYQVRRKAVEELESKDLSELYTSDGYLIEALEKAFTEGEKYLNNEDDKENKKDSKKKPIKKYMEKEHIDVFWTTNGQPVRKVSLKGTPVSNYYKKSINETNYSILGVPKYYCVEVYKDTKGKTRIWGIRYVDVISCEGKICLKDDIKLPKKYAKHLIYLFSGEYLEVTEDGKETYVGFYQSVKAATQSKINITINPGKKGKGNDGKEKIQWTKVIPITQKATVKKYVITLNGQKAGEVKEGEAGYPCFAHCLSRKEND

SEQ ID NO: 8411 - protein, 943 aa, unidentified
  REGION 1..943: note = Description of Unknown:uncultivated organism sequence
MNQILPVKVRGIDEKLTKAELLQVLIHACNHRGYKDFYEVTETDEAESQEEEDEKINQAAADRLDRSFEKSHCRTISEYICRYCTIPGTDRIDYRNRFYKNENRMIIRRKHVENEVCTILKKQREWYPELTDQKIEKIMEVIFSQRDFEDGPGYSSDKAEYRRYTGFLESIGYCRFYPEERRGFRNTALGDVYAAINALSQYRYVHTDTGETKLSQEAAAKMVSYIMKQGSLTRTQAAKLLKLLGIAIYGSKDVDKTLVKSFRFLKEMKKIAEKCQVSWESLLSETDLTEYEEGKTSLLNQLGTVCSMYQTPHKKEEQLKKLHAKWEHAHLPPAFWNALKRHRFSGTSSVSYHHMADAIEAFLKGDKGDIYGNFQWNKQKQLDKKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLDEKEILTGWKSRNINDTRYITKYVVGLIKNHLQFAGGKARVFGIRGHITSRFRKEWLGKNTWGSEKKCRTNYLNHAADAIVLANLSKMDVEIAMDYEKLRQIQRHYGETSIQYDHFLNHAAQRIATFYPITEEAVRKQLVESERTPSYVPNLEKEVDLRLGNPEGETRSEEEYRAETEMYYEGAAFVVKPHLPYVSMKVEKKFRGEIADSNPIRLVEENGIFYQVRRKAVEELESKDLSELYTSDGYLIEALEKAFTEGEKYLNNEDDKENKKDSKKKPIKKYMEKEHIDVFRTTNGQPVRKVSLKGTPVSNYYKKSINETNYSILGVPKYYCVEVYKDTKGKNLLKR

SEQ ID NO: 8412 - protein, 1157 aa, unidentified
  REGION 1..1157: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTEIDEAESQEEEDEKINQAAADRLDRSFEESHCRTISEYICRYCTIPGTDRIDYRNRFYKNENRMIIRRKHVENEVCTILKKQKEWYPELTDQKIEKIMGVIFSQRDFEDGPGDASDKYRRYTGFLESLGYCRFYPEERRGFRNTALGDVYAAINALSQYRYVHTDTGEAKLSQEAAAKMVSYIMKQGSLTRTQAVKLLKPLGIAIYGSKDVDKTLAKSFRFLKEMKKMAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQNHAYEVDHIIPYSLILDNTLANKALVCGNENQAKGQQTPLMYLKGEKKEAFIERVKAEKKRTSHPISNKKYDYLMLATLYGKETKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRRHYGETSIQYDHFLKNAAKRIAAFYPITEEAIRKQLVESERTPSYVPNLEKEVDLRLGNPEGETRSEEEYRAKTEMYYEGAAFVVKPHLPYVSMKVEKKFRGEIADSKPIRLVEENGIFYKVSRKAVEDLEAKNLPDLYTSDGYLIEALEKAFTEGEKYLNNEDDKENKKDSPKKPIKKYMEKEHLDVFRTTNGQPVRKVSIKECSVSNYYKKNIDDTNYSILGVPKYYCVEVYTNSKGQTQIWGLRFVDMISYEGKLYLKDGVRPADYARHVMYLFPGEYIEVEKKGKIVYGGTYQNVFNINQGKLRIKVKNTNALKTISIGNKAGVFKYAISLNGCKSGVVKEGEVGYPCFAHCLSKKEND

SEQ ID NO: 8413 - protein, 1062 aa, unidentified
  REGION 1..1062: note = Description of Unknown:uncultivated organism sequence
MKRKYGIGLDIGIGSCGWCIISWELPDKSDARIEDLGVRLFDSGEISYEATAQKNRKNQERRNYRSVRRLLRRRKHRKERVKRFLQKIGLINCYELQRWQELNGNQNIFAVRFKGLSEKLTPEEIADCIIHICNHRGYRDFYDDEQDDDEAQITKQRLLNFETIYREGKYVSVADIILHDDAFTTGTDFPDYHNHKLKPGEDISKSERYILIARNNVKKELLDILNKQQEFYPKELTEKNIDFIVNEIVFAQRDFETGPGKEGDSTRKFMSFLDSLGNCRFYKDERRAFRSTIIADIYALINSLSQFTYVDIKTGEVILKTEASKAIINMALENGGITEADIKKILKHYDLEWVKPSGLSEKIPDTVKTLKTLKRILEQNGYSYQELIKEEQFDLEYPSRLHALCICLSENITPARRKKALSKLGWSEKLQDALVRQKFGGTASVCEQYMLDAIKAFCDGEAYGNFQARILKNIELQNANVTKHVLLPVITKVFDEDITKNVVVFKSINEVRKVINALVRKYGSPEYINVEVADELGKSFMQRKKIEKENKNNRKNTEEIASKLVELGLRKEGEVKSGDILKYRLWLSQGGIDLYTGEIIDTNQILSYQYEVDHIVPFSLILDDTIHNKALVNLGANRAQKAQQVPLEYLQGLQRDTFLKNVNLLFKKKKISQKKYQYLMMESLGGEKAQEILAEWKSRNINDTRYITRYIVNYLTNNLQFTGDQDKKHVFGIKGALTSRLRKIWLKGTAWGSDEKSRENNLHHAADAVVIANMTPACIELASDNIKLNSIFYSNRKRRNTEYDVYLEKAKRKMEKYYGYAPEYTEMLLTKHGRVPSIIRRITEETFIRLTDPTVDGYVNVTKENFECNVKAFYADNPELAGGITMPLVSYKQEKKYQGKMTKDGAVRKQEADDKLLLKEDAKGNITALPANLYYCIEVYKDVQGATQLRGVRFVDLVKRDKKLWLRYAYPEDYKSHVMYLFANDYIRIFNSKGVVKFEGYYKSVKSIFRNYIYAKNNNSNSAVAIGIAKKDTVKKFDVDILGKIGGEVQCSAPFMLLPENV

SEQ ID NO: 8414 - protein, 1056 aa, unidentified
  REGION 1..1056: note = Description of Unknown:uncultivated organism sequence
MSDYEIRCACESPADKVLLTKVKGLDEKLSKAELLQALLHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGEAKLSQEAAAKMVSYIMKQGSLTRTQAAKLLKPLGIAIYGSKDVDKTLAKSFRFLKEMKKMAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKILMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSEEKCRANYLNHAADAIVLANLSKMDVEIAMDYEKLRQIQRHYGEMSIQYDHFLNHAAQRIAAFYPITEEAIRKQLVESKRTPSYVPNLEKEVDLRLGNPEGETRSEEEYRAKTEMYYEGAAFVVKPHLPHVSMKVEKKFRGEIADSNPIRLVEENGIQYKISRLKVEELKREQLSKLYTSDGYLIKALEEAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARYVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8415 - protein, 1043 aa, unidentified
  REGION 1..1043: note = Description of Unknown:uncultivated organism sequence
MNQILPVKVRGIDEKLTKAELLQVLIHACNHRGYKDFYEVMEIDAAESQEEEDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESIGYCRFYPEERRGFRNTALGDVYAAINALSQYRYVHTDTGEAKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKAKVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLAESKRTLSYVQNLGREVDLRLGNPEGETRSEEEYRAETEMYYEGAAFVVKPHLPYVSMKVEKKFRGEIADSNPIRLVEENGIQYKISRLKVEELKREQLSKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYMKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8416 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEKADGKDRKSQERRGFRSVRRVLRRRSHRKYRLKNYLRYVHFMTDMEIRCASEASMNQILPVKVRGIDEKLTKAELLQVLIHACNHRGYKDFYEVTETDEAESQEEDDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEQVHFPPAFWNALKRHKFNGTSSVSYHHMVDAIEAFLKGDIYGNFQWNKQKQLDEKQESQRERLLSAKILMQDEDVKDNPVVLRSINETRKVLNCLIRLYGSPAEIHVEVADDVARSYLERKRIQKIQRDHEKTRDAIKKKIAEILHCTESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRHHYGEMSIQYDHFLNHAAQRIAAFYPITEEAIRKQLAESKRTPSYVPNLGREVDLRLGNPEGETRSEEEYRAKTEMYYEGAAFVVKPHLPYVSMKVERKFRGEIADSNPIRLVEENGIQYKISRSKVEELKREQLPKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYLKDGVRPADYARHVMYLFPGEYIEVEKKGKIVYEGTYQNVYSINQGVLRIKVKNTNALKPISIGNKAGVFKYAISLNGCKSGAVKEGEAGYPCFAHCLSKKEND

SEQ ID NO: 8417 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGEAKLSQEVAAKMVSYIMKQGSLTRTQAAKLLKPLGIAIYGSKDVDKTLAKSFRFLKEMKKIAEKSQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKCTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYPCFAHCLLKKEND

SEQ ID NO: 8418 - protein, 1136 aa, unidentified
  REGION 1..1136: note = Description of Unknown:uncultivated organism sequence
MLLISASDLVDGPWFSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLDSLGYCRFYPEERRGFRNTALGDVYAAINALSQYRYVHTDTGETKLSQEAAAKMVSYIMKQGSLTRTQAAKLLKPLGIAIYGSKDVDKTLVKSFRFLKEMKKIAEKCQVSWESLLSETDLTEYEEGKTSLLNQLGKVCSMYQTPHKKEEQLKKLHAKWEHAHLPPAFWNALKRHRFSGTSSVSYHHMADAIEAFLKGDKGDIYGNFQWNKQKQLDKKQESQRERLLSAKVLMQDEDVKDNPVVLRSINETRKVLNYLIRLYGSPAEIHVEVADDVARSYLERKRIQKMQENNEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYEKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESQRTPSYVPNLEKEVDLRLGNPEGETRSEEEYRAKTEMYYEGAAFVVKPHLPYVSMKVERKFRGKIADSNPIRLVEENGIQYKISRSKVEELKREQLPKLYTSDGYLIKALEKAFENKDVKTVKDYMEKEHLDVFRTTNGQPVRKVSINEGKISSYYKKNIDDMNYSILGMPKYYCVEVYTNDKGQTKIWGLRFVDMIYYEGKLYLKDGVRPADYARHVMYIFKGEYIKVVTKGKVVCEGTYQNVEAINEKKLNIKIKNTNILQKPIPRIGNKTKVSKYAISLNGCKSGMVKEGETGYPCFAHCLLKKEND

SEQ ID NO: 8419 - protein, 1043 aa, unidentified
  REGION 1..1043: note = Description of Unknown:uncultivated organism sequence
MNQILPVKVRGIDEKLTKAELLQVLIHACNHRGYKDFYEVTETDEAESQEEDDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRHHYGEMSIQYDHFLNHAAQRIAAFYPITEEAIRKQLAESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8420 - protein, 1062 aa, unidentified
  REGION 1..1062: note = Description of Unknown:uncultivated organism sequence
MKRKYGIGLDIGIGSCGWCIISWELPDKSDARIEDLGVRLFDSGEISYEATAQKNRKNQERRNYRSVRRLLRRRKHRKERVKRFLQKIGLINCYELQRWQELNGNQNIFAVRFKGLSEKLTPEEIADCIIHICNHRGYRDFYDDEQDDDEAQITKQRLLNFETIYREGKYVSVADMILHDDAFTTGTDFPDYHNHKLKPGEDISKSERYILIARNNVKKELLDILNKQQEFYPKELTEKNIDFIVNEIVFAQRDFETGPGKEGDSTRKFMSFLDSLGNCRFYKDERRAFRSTIIADIYALINSLSQFTYVDIKTGEVILKTEASKAIINMALENGGITEADIKKILKHYDLEWVKPSGLSEKIPDTVKTLKTLKRILEQNGYSYQELIKEEQFDLEYPSRLHALCICLSENITPARRKKALSKLGWSEKLQDALVRQKFGGTASVCEQYMLDAIKAFCDGEAYGNFQARILKNIELQNANVTKHVLLPVITKVFDEDITKNVVVFKSINEVRKVINALVRKYGSPEYINVEVADELGKSFMQRKKIEKENKNNRKNTEEIASKLVELGLRKEGELKSGDILKYRLWLSQGGIDLYTGEIIDTNQILSYQYEVDHIVPFSLILDDTIHNKALVNLGANRAQKAQQVPLEYLQGLQRDTFLKNVNLLFKKKKISQKKYQYLMMESLGGEKAQEILAEWKSRNINDTRYITRYIVNYLTNNLQFTGDQDKKHVFGIKGALTSRLRKIWLKGTAWGSDEKSRENNLHHAADAVVIANMTPACIELASDNIKLNSIFYSNRKRRNTEYDVYLEKAKRKMEKYYGYAPEYTEMLLTKHGRVPSIIRRITEETFIRLTDPTVDGYVNVTKENFECNVKAFYADNPELAGGITMPLVSYKQEKKYQGKMTKDGAVRKQEADDKLLLKEDAKGNITALPANLYYCIEVYKDVQGATQLRGVRFVDLVKRDKKLWLRYAYPEDYKSHVMYLFANDYIRIFNSKGVVKFEGYYKSVKSIFRNYIYAKNNNSNSAVAIGIAKKDTVKKFDVDILGKIGGEVQCSAPFMLLPENV

SEQ ID NO: 8421 - protein, 1045 aa, unidentified
  REGION 1..1045: note = Description of Unknown:uncultivated organism sequence
MMKRKYGIGLDIGVGSVGFAVVSRTNDEDARIETLGARLFDSGETADRKASLSQERRAYRSVRRLIRRRKHRKDRAKFFLQKIGLISKEKLQAWQEVNGNQNVLETRLKGLTEKLTPEEIADCIIHICNHRGYREFYEDENNDKDAGLIKTGLSDFEKCYHDGGYKSVADMLLHDEKFKTETEFTDYHNHKNGERYILIKREYVREELLAILRRQQEFYPQLTDDNITFLCDKIIFAQRDFETGPGNPNDKDRKFMGFLDTLGKCMFYKTEDRAFRSTVLADIYSLVNCLSQMSFVDTATGEIILPEDAAENIINTTLFNGGMTESDLKKLLKKHGLEMRKPGKLEVKIPDTVKTLKVLKSVLEQCGYDYTELITENQFDLEHPSRLQQLCRILSENITPRRRKQALAKAGWNKALQEAMLRRKFGGTASVCEKYMLEAISAFKHGETYGNFQARRLKERAAEQQPQEKHLLLPPLTMKQDEEITKNIVVFKAINETRKVLNAIIRRYGSPEYINIEVADDLGRSVSERMKLTKMMRDNEKTRQKIAEKIVELGLRKEGEVKEGDIARYKLWQEQGGIDLYSGEPIAENAVLSGIYDIDHIVPFSLILDYTLQNKALVNMGANRQGKHQQVPFQYLQGEQKTRFLQNVNLLFKKGKISAKKYKYLMLPNLYNTEILAEWKSRNINDTRYITRYIVNYLTANLKFANEEKKKNVYAVKGAITSRMRKNWLNKKSWGSIDKDRSNNLHHAADALVIANLTPAYVEIASDNMKLNKIYREHHKQISFEYTDYMEKAVRKMQKYYGFNEDYARRLLEAKGRIPSIIRNLEREADIRLTDDSMEFYQDKDASSFAEKVADFYRDDPQFAAGLQMPLVSYKQNKKFQGTVTGSEPKKISKIKGVPLAKIDTLGNANYYDSSNYYCIELYETTDGKNNLRGIRYADLRKQDKKLYLTAENPADYKQHKMYLFANDYIEVIGGKGNLKFSGYYKSVFNINQNIFYIAIKNNNKAIPKFIGQKDTIKKHSVDILGQMGGEVKCSAPFMLLREKK

SEQ ID NO: 8422 - protein, 1059 aa, unidentified
  REGION 1..1059: note = Description of Unknown:uncultivated organism sequence
MNQILPVKVRGIDEKLTKAELLQVLIHACNHRGYKDFYEVTETDETESQEEEDEKINQAAADRLDRSFEESHCRTISEYICRYCTIPGTDRIDYRNRFYKNENRMIIRRKHVENEVSTILKKQREWYPELTDQNIKEIMEVIFSQRDFEDGPGDASDKYRRYTGFLESLGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEQVHFPPAFWNVLKRHKFNGTSSVSYHHMSDAIEAFLKGDIYGNFQWNKQKQLDEKQESQRERLLSAKVLMQDEDVKDNPVVLRSINETRKVLNCLIRLYGAPAEIHVEVADDVARSYLERKRIQKMQRDHEKTRDAIKKKIAEILHCEESEVKGIQIERYKLYMEQEGKCLYSGRALDLEMVLDTKSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSDEKCRTNYLNHAADAIVLANLSKMDVEIAMDYEKLRQIRRHYGETSIQFDHFLKNAAQRIAAFYPVTEEAIRKQLVESKRTPSYVPNLGREVDLRLGNPEGETRSEEEYRAKTEMYYEGAAFVVKPHLPYVSMKVEKKFRGEIADSKPIRLVEENGIFYKVSRKAVEDLEAKNLPDLYTSDGYLIEALEKAFTEGEKYLNNEDDKENKKDPPKKPIKKYMEKEHLDVFRTTNGQPVRKVSIKECSVSNYYKKNIDDTNYSILGVPKYYCVEVYTNSKGQTQIWGLRFVDMISYEGKLYLKDGVRPADYARHVMYLFPGEYIEVEKKGKIVYGGTYQNVFNINQGKLRIKVKNTNALKTISIGNKAGVFKYAISLNGCKSGVVKEGEAGYPCFAHCLSKKEND

SEQ ID NO: 8423 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESLGYCRFYPEERRGFRNTALGDVYAAINALSQYRYVHTDTGEAKLSQEVAAKMVSYIMKQGSLTRTQAAKLLKPLGIAIYGSKDVDKTLAKSFRFLKEMKKIAEKSQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIHLYGSPAEIHVEVADDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLNHATQRIAAFYPITEEAIRKQLVESKRTPSYVPNLGREVDLRLGNPEGETRSEEEYRAETEMYYEGAAFVVKPHLPYVSMKVEKKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQAKIWGLRFVDMISYEGKLYLKDGVRPADYARHVMYLFPGEYIEVEKKGKIVYEGTYQNVYNINQGVLSIKVKNTNALKPISIGNKAGVFKYAISLHGCKSGEVKEGEAGYPCFAHCLSKKEND

SEQ ID NO: 8424 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESLGYCRFYPEERRGFRNTALGDVYAAINALSQYRYVHTDTVEAKLTQEAAAKMVSYIMKQGSLTRTQAAKLLKPLGIAIYGSKDVDKTLAKSFRFLKEMKKIAEKSQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYSCFAHCLLKKEND

SEQ ID NO: 8425 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRKHRKELLKNYIRYIQFMSDYEIRCACESPADKVLLTKVKGLDEKLSKAELLQALLHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGEAKLTQEAAAKMVSYILKQGSLTRTQAAKLLKPLGIAIYGSKDVDKTLAKSFRFLKEMRKIAEKCQVSWESLLSETDLTEYEEGKTSLLNQLGTVCSMYQTPHRKEEELKKLHANWEHVHLPPAFWNALKRHKFNGTSSVSYHHMADAIEAFLKGDIYGNFQWNKQKQLDEKQESQRERLLFAKVLMQDADVKDNPVVLRSINETRKVLNCLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKKHLDVFRTTNGQPVRKVSIKGMPVSNYYKKRINETNYSILGVPKYYCVEVYTNDKGQTKIWGLRFVDMVSYERKLYLKDGVRPADYARHVMYLFPGEYIEVAKNGKIVYEGIYQNVYAINEGRLRIKVKNTNALKPIRIGNKIEVFKYTITLNGCKSGEVQEGEAGYPCFAHCLSKKEND

SEQ ID NO: 8426 - protein, 1043 aa, unidentified
  REGION 1..1043: note = Description of Unknown:uncultivated organism sequence
MNQILPVKVRGIDEKLTKAELLQVLIHACNHRGYKDFYEVTETDEAESQKEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGETKLSQEAAAKMVSYIMKQGSLTRTQAAKLVKPLGIAIYGSKDVDKTLAKSFRFLKEMKKIAEKTQVSWESLLSETDLTEYEEGKTSLLNQLGTVCSMYQTPHKKEEELKKLRAKWEHAHLPPAFWNALKRHKFNGTSSVSYHHMADAIEAFLKGDIYGNFQWNKQKQLDEKQESQRERLLSAKILMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVRPHLPYVSMKVERKFRGEIADSNPIRLVEENGIQYKISRSKVEELKREQLPKLYTSDGYLIEALEKAFENKDVKTVKDYMEKEHLDVFRTTNGQPVRKVSIKGMPVSNYYKKRINETNYSILGVPKYYCVEVYTNSKGQTKIWGLRFVDMISYEGKLYLKDGVRPADYARHGMYLFPGEYIEVEKRGKIVYEGTYQNVYSINQGVLRIKVKNTNALKPISIGNKAGVFKYAISLNGCKSGAVKEGEAGYPCFAHCLSKKEND

SEQ ID NO: 8427 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQKEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGETKLSQEAAAKMVSYIMKQGSLTRTQAAKLVKPLGIAIYGSKDVDKTLAKSFRFLKEMKKIAEKTQVSWESLLSETDLTEYEEGKTSLLNQLGTVCSMYQTPHKKEEELKKLRAKWEHAHLPPAFWNALKRHKFNGTSSVSYHHMADAIEAFLKGDIYGNFQWNKQKQLDEKQESQRERLLSAKILMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVRPHLPYVSMKVERKFRGEIADSNPIRLVEENGIQYKISRSKVEELKREQLPKLYTSDGYLIEALEKAFENKDVKTVKDYMEKEHLDVFRTTNGQPVRKVSIKGMPVSNYYKKRINETNYSILGVPKYYCVEVYTNSKGQTKIWGLRFVDMISYEGKLYLKDGVRPADYARHGMYLFPGEYIEVEKRGKIVYEGTYQNVYSINQGVLRIKVKNTNALKPISIGNKAGVFKYAISLNGCKSGAVKEGEAGYPCFAHCLSKKEND

SEQ ID NO: 8428 - protein, 1056 aa, unidentified
  REGION 1..1056: note = Description of Unknown:uncultivated organism sequence
MNQILPVKVRGIDEKLTKAELLQVLIHACNHRGYKDFYEVTETDEVESQEEEDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGEAKLTQEAAVKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHKKEEELKKLHAKWEYVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKIQRDHEKTRDAIKKKIAEILHCEESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGGKARVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVRPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGMSVSNYYKKSINETNYSILGVPKYYCVEVYKDTKGKTRMWGIRYVDVISCEGKICLKDDIKLPKKYAKHLIYLFSGEYLEVTEDGKETYVGFYQSVKAATQSKINITINPGKKGKGNDGKEKIQWTKVIPITQKATVKKYVITLNGQKAGEVKEGEAGYPCFAHCLSKKEND

SEQ ID NO: 8429 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKFFNPNIFQLKYDGLSKKLSPEEIFAIIIHFCNHRGYKDFYEEDATTINEKERGKIKTALSNFEKIYKDNGYISVSEMILKDPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKINDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTQILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILSEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYDFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8430 - protein, 1050 aa, unidentified
  REGION 1..1050: note = Description of Unknown:uncultivated organism sequence
MNRSYGLGLSIGIGTVSYTVLSQIKDTNNIIDNDVRIEDIGVRMFETGETPDHKNSLNQDRRSYRASRRLIRRRKHRKERVKHFLERIQFINYDKYRTWKKIFNPNIFQLKYDGLSKKLSPEEIFAIVIHFCNHRGYKDFYEEDATTINEKERGKIKTALSNFEKIYKDNGYISVSEMILKDPIFLGKGNYPDYHNHAIKNKQDNIEPRFFLIKREYLRKELINILKKQQQYYSKLTDKRINFICDNIVFIQRDFEDGPGDKKDSTRKYMGFLDSIGNCIYYKNEKRAFRTTIISDIYSLINQLSQVYFIDKNTEEISFSKEAANEIIDYVLINASLTEKDLKNILKKYDLILNKPGNLKLKINDCLKALKILKNTLEKCGYDYTSLIKEEQFNLEQPSKLQKLCILLSKNITPKRRILALQKAGYNKELQQEMIRKNFSSTANVSEKYMIQAIEAFKHGENYGNFQARMFKDKYNNITKKEKHLLLPSLTLKDDEDIVKNVVVFKAINETRKVINALIRKYGSFKYINILASDELGHSIQERKRIVKMQNKNRKETQNIRTKILELGLKKEDEITTQDIQRYKLYQQQNGIDLYTGSIIPENEILGTNYEIDYIVPFSLILDDTLNNKVLTKISINRITKNTKLPLQFLENEALDFYKKTVTTLFNKGKISSKKYNYLLLPILNEEILFEWKSRNLNDTRYICKFITNYISSNLIFDSNKKKNVYAIKAPIISKMRKIWLNKKTWGAKELDKTNNLYHAVNALVAANLTPAYVEIVYDNIRLQQIYREHHKTISNEYIDYLNKSINKMQKYYGFSIEYSQKLLRSLGKVPAILKNIWAEADIRLADNTIEYYKDIDDERFRQNICSFYQDKEFAESVQKVIVSYKSYKKFQGKITDDNPLPLSKNKSSYIKKMNNILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 8431 - protein, 1156 aa, unidentified
  REGION 1..1156: note = Description of Unknown:uncultivated organism sequence
MEKRQYRFAFDIGIGSCVWAVVSENETGNRRIEDAGSRIFDSGEMKEGKDRKSQKRRGFRGVRRVLRRRSHRKYRLRNYLRYVHFMTDMEIRCASEASMNQILPVKVRGIDEKLTKAELLQVLIHACNHRGYKDFYEVTETDEAQSQEEEDEKINQAAADRLDRSFEESHCRTISEYICRYCTIPGTDRIDYRNRFYKNENRMIIRRKHVENEVSTILKKQREWYPELTDQKIKEIMEVIFSQRDFEDGPGYASDKAEYRRYTGFLESIGYCRFYPEERRGFRNTALGDVYAAINALSQYRYVHTDTGETKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRGAIKKKIAEILHCEESEVKGSQIERYKLYMEQEGKCLYSGRELNLEMVLDTQSHAYEVDHIIPYSLILDNTLANKALVCGNENQAKGRQTPLMYLKGEKKEAFIERVKAEKKRTNHPISNKKYDYLMLATLYGKEAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIRRHYGETSIQYDHFLKNAAQRIAAFYPITEEAIRKQLVESKRTPSYVPNLEKEVDLRLGNPEGETRSEEEYRAKTEMYYEGVAFVVKPHLPYVSMKVERKFRGEIAKSNPIRLVEGNGIFYQVSRKPVEELESKDLSELYTSDGYLIEALEKAFTEGVNNEDDKENKKDSKKKPIKKYMEKEHIDVFRTTNGQPVRKVSLKGTPVSNYYKKSINETNYSILGVPKYYCVEVYTNSEGQTQIWGLRFVDMISYEGKLYLKDGVRPADYARHVMYLFPGEYIEVEKKGKIVYEGTYQNVFNINQGKLRIKVKNTNALKTISIGNKAGVFKYAISLNGRKSGVVKEGEAGYPCFAHCLSKKEND

SEQ ID NO: 8432 - protein, 1144 aa, unidentified
  REGION 1..1144: note = Description of Unknown:uncultivated organism sequence
MEKRQYRFAFDIGIGSCGWAVVSENETGNRRIADAGSRIFDSGEMKEGKDRKSQERRGFRGVRRVLRRRKHRKELLKNYIRYIQFMSDYEIRCACESPADKVLLTKLKGLDEKLSKAELLQALLHACNHRGYKDFYEVTETDEAESQEEEDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESLGYCRFYPEERRGFRNTALGDVYAAINALSQYRYVHTDTGETKLGQEAAAKMVSYIMKQGSLTRTQAAKLLKPLGIAIYGSKDVDKTLVKSFRFLKEMKKIAEKCQVSWESLLSETDLTEYEEGKTSLLNQLGTVCSMYQTPHKKEEELKKLHAKWEHAHLPPAFWNALKRHRFSGTSSVSYHHMADAIEAFLKGDKGDIYGNFQWNKQKQLDKKQESQRERLLSAKVLMQDEDVKDNPVVLRSINETRKVLNCLIRLYGSPAEIHVEVADDVARSYLERKRIQKMQRDHEKTRDAIKKKIAEILHCAESEVKGIQIERYKLYMEQEGKCLYSGRELDLEMVLDTQSHAYEVDHIIPYSLILDNTLANKALVCGNENQAKGQQTPLMYLKGEKKEAFIERVKAEKKRASHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAVYPITEEAIRKQLVESKRTPSYVPNLEKEVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8433 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQERRGFRGVRRVLRRRKHRKELLKNYIRYIQFMSDYEIRCACESPADKVLLTKVKGLDEKLSKAELLQALLHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGEAKLTQEAAAKMVSYILKQGSLTRTQAAKLLKPLGIAIYGSKDVDKTLAKSFRFLKEMRKIAEKCQVSWESLLSETDLTEYEEGKTSLLNQLGTVCSMYQTTHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNYLIRLYGSPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLTGEKKAAFIERVKAEKGRTSHPISNKKYDYLMLSTLYGEEAKGILAGWKSRNINDTRYITKYIVGLIKNHLQFAGEKPRVFGIRGHITSRFRKEWLGKNTWGSEEKCRENYLNHAADAIVLANLSKMDVEIAMDYEKLHQIQRHYGETSIQYDHFLKNAAQRIAAFYPITEEAIRKQLVESKRTPSYVPNLGREVDLRLGNPEGETRSEEEYRAETEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGMPVSNYYKKSINETNYSILGMPKYYCVEVYTNSKGQTQIWGLRFVDMISYEGKLYLKDGVRPADYARHVMYLFPGEYIEIEKKGKIVYEGTYQNVYNINEGRLRVKVKNTNALKPISIGNKVGVFKYAISLNGCKSGVVKEGEAGYPCFAHCLSKKEND

SEQ ID NO: 8434 - protein, 1044 aa, unidentified
  REGION 1..1044: note = Description of Unknown:uncultivated organism sequence
MMKRKYGIGLDIGVGSVGFAVISRTNDEDARIETLGARLFDSGENSKKTATLSQERRMKRAHRRLLRRRKHRKDRVKFFLQKIGLISKEKLQAWQEVNGNQNVLQTRLNGLTEKLAPEEIADCIIHICNHRGYREFYEDENNDKDAGLIKTGLSDFEKCYHDGGYKSVADMLLHDEKFKTETEFTDYHNHKNGERYILIKREYVREELLAILHRQQEFYPQLTDDNITFLCDRIIFAQRDFETGPGDPNDKDRKFMGFLDTLGKCMFYKTEDRAFRSTVLADIYSLVNCLSQMSFVDTATGEIILPEDAAEDIINTALLNGGMTESDLKKLLKKHGLEMRKPGKLEVKIPDTVKTLKVLKSVLEQCGYDYTELIAENQFDLEHPSRLQQLCRILSENITPRRRKQALAKAGWNKALQEAMLRRKFGGTASVCEKYMLEAISAFKHGETYGNFQARRLKERAAEQPTQEKHLLLPPLTMKQDEEITKNIVVFKAINETRKVLNAIIRRYGSPEYINIEVADDLGRSVSERMKLTKLMRDNEKARQKIAEKIIELGLRKEGEVKEGDIARYKLWQEQGGIDLYSGEPIAENAVLSGIYDIDHIVPFSLILDDTLQNKALVNMGANRQGKHQQVPLQYLQGEQKTRFLQNVNLLFKKGKISAKKYKYLMLPNLYNAEILAEWKSRNINDTRYITRYIVNYLTANLKFANEEKKKNVYAVKGAITSRMRKNWLNKKSWGSIDKDRSNNLHHAADALVIANLTPAYVEIASDNMKLNKIYREHHKQISFEYTDYLEKAVRKMQKYYGFNEAYARRLLEAKGRIPSIIKNLEREADIRLTDESMEFYQDKDASSFAEKVADFYRDDPQFAAGLQMPLVSYKQNKKMQRSITGDEPKKLKEVKSPLGKIDTLGNINYYDAASYYCVELYETTDGKNNLRGIRYADLRKQNKKLYLTAENPADYKQHKMYLFANDYIKIIDSKGELKFRGYYRKVHNINRGVFYCLNNNDSQRIDCSIGKKDIVQKYSVNILGQIGGEVKCSAPFMLRREKK

SEQ ID NO: 8435 - protein, 1143 aa, unidentified
  REGION 1..1143: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLQYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGYASDKAEYRRYTGFLESIGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTKSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKAKVFGIRGHITSRFRKEWLGKNTWGSDEKCRANYLNHAADAIVLANLSKMDVEIAMDYEKLRQIRRHYGETSIQYDHFLKNAAQRIAAFYPITEEAIRKQLVESKCTPSYVPNLGREVDLRLGNPEGETRSEEEYRAKTEMYYEGAAFVVKPHLPYVSMKVERKFRGEIADSNPIRLVEENGIQYKISRSKVEELKREQLSKLYTSDGYLIEALEKAFENKDVKTVKDYMEKEHLDVFRTTNGQPVRKVSIKGTAVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8436 - protein, 1141 aa, unidentified
  REGION 1..1141: note = Description of Unknown:uncultivated organism sequence
MEKRQYRFAFDIGIGSCGWAVVSENETGNRRIEDAGSRIFDSGEMKEGKDRKSQKRRGFRGVRRVLRRRSHRKYRLKNYLRYVHFMTDMEIRCASEASMNQILPVKVRGIDEKLTKAELLQVLIHACNHRGYKDFYEVTETDEAESQEEEDEKINQAAADRLDRSFEESHCRTISEYICRYCTIPGTDRIDYRNRFYKNENRMIIRRKHVENEVCTILKKQREWYPELTDQKIKEIMEVIFSQRDFEDGPGDASDKYRRYTGFLESLGYCRFYPEERRGFRNTALGDVYAAINALSQYRYVHTDTGEAKLTQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLRAKWEQVHFPPAFWNALKRHKFNGTSSVSYHHMADAIEAFLKGDIYGNFQWNKQKQLDEKQESQRERLLSAKVLMQDEDVKDNPVVLRSINETRKVLNCLIRLYGSPAEIHVEVADDVARSYLERKRIQKMQRDHEKTRGAIKKKIAEILHCEESEVKGSQIERYKLYMEQEGKCLYSGRELNLEMVLDTQSHAYEVDHIIPYSLILDNTLANKALVCGNENQAKGQQTPLMYLKGEKKEAFIERVKAEKKRTNHPISNKKYDYLMLATLYGKGAKEILTGWKSRNINDTRYITKYVVGLIKNHLQFAGGKARVFGIRGHITSRFRKEWLGKNTWGSEEKCRTNYLNHAADAIVLANLSKMDVEIAMDYEKLRQIQRHYGEMSIQYDHFLNHAAQRIAAFYPITEEAIRKQLVESERTPSYVPNLEKEVDLRLGNPEGETRSEEEYRAKTEMYYEGAAFVVKPHLPYVSMKVEKKFRGEIADSNPIRLVEENGIQYKISRSKVEELKREQLSKLYTSDGYLIEALEKAFENKDVKTVKDYMEKEHLDVFRTTNGQPVRKVSIKGMPVSNYYKKSINETNYSILGVPKYYCVEVYTTSKGQTKIWGLRFVDMISYEGKLYLKDGVRPADYARHVMYLFPGEYIEVEKKGKIVYEGTYQNVYNINQGVLRIKVKNTNALKPISIGDKAGVFKYAISLNGCKSGVVKEGEAGYPCFAHCLLKKEND

SEQ ID NO: 8437 - protein, 1143 aa, unidentified
  REGION 1..1143: note = Description of Unknown:uncultivated organism sequence
MEKRQYRFAFDIGIGSCGWAVVSENETGNRRIEDAGSRIFDSGEMKEGKDRKSQERRGFRGVRRVLRRRSHRKYRLKNYLRYVHFMTDMEIRCASEASMNQILPVKVRGIDEKLTKAELLQVLIHACNHRGYKDFYEVTETDEAQSQEEEDEKINQAAADRLDRSFEESHCRTISEYICRYCTIPGTDRIDYRNRFYKNENRMIIRRKHVENEVSTILKKQREWYPELTDQKIKEIMEVIFSQRDFEDGPGYASDKAEYRRYTGFLESIGDCRFYPEERRGFRNTALGDVYAAINALSQYRYVHTDTGEAKLTQEAAAKMVSYILKQGRLTRTQAAKLLKPLGIAIYGSKDVDKTLEKSFRFLKEMKKIAEKCQVSWESLLSETDLTEYEEGKTSLLNQLGTVCSMYQTPHRKEEELKKLHAKWEHVHLPPAFWNALKRHKFNGTSSVSYHHMADVIEAFLKGDIYGNFQWNKQKQLDKKQESQRERLLSAKVLMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSEEKCRTNYLNHAADAIVLANLSKMDVEIAMDYEKLRQIRRHYGEMSIQYDHFLNHAAQRIAAFYPITEEAIRKQLVESKRTPSYVPNLGREVDLRLGNPEGETRSEEEYRAETEMYYEGAAFVVKPHLPYVSMKVEKKFRGEIADSNPIRLVEENGIQYKISRSKVEELKREQLSKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYLKDGVRPADYARHVMYLFPGEYIEVEKKGKIVYEGTYQNVYNINQGVLRIKVKNTNALKPISIGDKAGVFKYTISLNGCKSGVVKEGEAGYPCFAHCLLKKEND

SEQ ID NO: 8438 - protein, 1045 aa, unidentified
  REGION 1..1045: note = Description of Unknown:uncultivated organism sequence
MMKRKYGIGLDIGVGSVGFAVISRTNDEDARIETLGARLFDSGETADRKASLSQERRGYRSVRRLIRRRKHRKDRVKFFLQKIGLISKEKLQAWQEVNGNQNVLQTRLNGLTEKLTPEEIADCIIHICNHRGYREFYEDENNDKDAGLIKTGLSDFEKCYHDGGYKSVADMLLYDEKFKTETEFTDYHNHKNGERYILIKREYVREELLAILHRQQEFYPQLTDDNITFLCDRIIFAQRDFETGPGDPNDKDRKFMGFLDTLGKCMFYKTEDRAFRSTVLADIYSLVNCLSQMSFVDTATGEIILPEDAAEDIINTALLNGGMTESDLKKLLKKHGLEMRKPGKLEVKIPDTVKTLKVLKSVLEQCGYDYTELIAENQFDLEHPSRLQQLCRILSENITPRRRKQTLAKAGWNKALQEAMLRRKFGGTASVCEKYMLEAISAFKHGETYGNFQARRLKERAAEQPTQEKHLLLPPLTMKQDEEITKNIVVFKAINETRKVLNAIIRRYGSPEYINIEVADDLGRSVSERMKLTKMMRDNEKARQKIAEKIIELGLRKEGEVKEGDIARYKLWQEQGGIDLYSGEPIAENAVLSGIYDIDHIVPFSLILDDTLQNKALVNMGANRQGKHQQVPLQYLQGEQKTRFLQNVNLLFKKGKISAKKYKYLMLPNLYDAEILAEWKSRNINDTRYITRYIVNYLTTNLKFANEEKKKNVYAVKGAITSRMRKNWLNKKSWGSIDKDRSNNLHHAADALVIANLTPAYVEIASDNMKLNKIYREHHKQISFEYTDYLEKAVRKMQKYYGFNEDYARRLLEAKGRIPSIIKNLEREADIRLTDESMEFYQDKDASSFAEKVADFYRDDPQFAASLQMPLVSYKQNKKFQGKITDDNPVKKSARKNSSLVKLDTLGNENILTASKYYCIELYETTDGKNNLRGIRYADLRKQDKKLYLTAENPADYKQHKMYLFANDYVKVIDGKGKLKFIGYYKSVHNINTRRLWMNNNNSNSSCDLTISAKDILKKYNVDILGQIGGEIKCSAPFMLLREKK

SEQ ID NO: 8439 - protein, 508 aa, unidentified
  REGION 1..508: note = Description of Unknown:uncultivated organism sequence
MITKKNKIAKKVSDRGLRKEGEVKPFDIERYRLWEEQEGKDLYTGEVIPVEKILSGIYDVDHIVPFSLILDDTLQNKALVNLGVNRQQKGQQVPLGYLSSADKEDYLKRVNTLFKKKKISIKKYKYLTLSNLYGNRDLLSEWKSRNINDTRYITRFLVNYLSANLLFDSDKTKNVFGVKGIITSRMRRLWLNKKTWGDEQKNRDNNLHHAADAIVIANLTPAYLEIASDKIKLDRIYKDYHKRISDEYLIYLGKAVNKMVKYYGFNKEYAEKLLATPYSRVPAIIRNIADEVDIRLWDNSLEFYKDVSEEQFYKNVKAFYKDDAAFADCIESVLVSYKQNKKYQGKFTKDNPLKKKEINSSSIEKVDSLGNVNVLDAKKYYCVEIYEDIKDKTSLRGIRYVDLKKQNKKLYLVSSKPADYKKHVMYLFANDYIEVFSDDGNLKFKGYYKSVEAITRNLLTYKFNNSTKELHKRIGKKDIVKKYYVDILGKIGGEIKCSVPFLSLKDNI

SEQ ID NO: 8440 - protein, 609 aa, unidentified
  REGION 1..609: note = Description of Unknown:uncultivated organism sequence
MIEAIEAFKRGETYGNFQARMLKERENALPDIEKQKYLAPFDKKVDEELVKNAVIFKAVNETRKILNELIRKYGSPEYINIEVANDLGRSFKERAKIIKRINDNKKEKDKIANKLIELGLRKEGEVKPFDIERYLLWEEQEGKDLYTGDVIPVEKILSGIYDVDHIVPFSLILDDTLQNKALVNLGVNRQQKGQQVPLGYLSSADKEDYLKRINTLFKKKKISIKKYKYLTLSNLYGNRDLLSEWKSRNINDTRYITRFLVNYLSANLLFNSDKAKNVFGVKGIITSRMRRLWFNKKTWGDEQKNRDNNLHHAADAIVIANLTPAYLEIASDKIKLDRIYKDYHKRISDEYLTYLGKAVNKMVKYYGFNKEYAEKLLATPNSRVPAMIRNIADETDIRLWDNSLECYKDVSEEQFYKNVRAFYKDDTVFADTIKPVLVSYKQNKKYQGKVADDTLYKNEEKGYYKKVISDNNKSILDARNYYCLELYKNIDDGISLRGIRYVDLKKQYKKLCINVSCPKDYKNHIMYLFNNDYIAIFDKNNNLKFNGYYKGLKSVNNRFIYVKNNNSNLSEYKTIGKKDIIKKYYVDILGKIGGEIKCSVPFLSLKDNI

SEQ ID NO: 8441 - protein, 1045 aa, unidentified
  REGION 1..1045: note = Description of Unknown:uncultivated organism sequence
MMKRKYGIGLDIGVGSVGFAVISRTNDEDARIETLGARLFDSGETADRKASLSQERRGYRSVRRLIRRRKHRKDRVKFFLQKIGLISKEKLQAWQEVNGNQNVLQTRLNGLTEKLTPEEIADCIIHICNHRGYREFYEDENNDKDAGLIKTGLSDFEKCYHDGGYKSVADMLLHDEKFKTETEFTDYHNHKSGERYILIKREYVREELLAILHRQQEFYSQLTDDNITFLCDRIIFAQRDFETGPGDPNDKDRKFMGFLDTLGKCMFYKTEDRAFRSTVLADIYSLVNCLSQMSFVDTATGEIILPEDAAEDIINTALLNGGMTESDLKKLLKKHGLEMRKPGKLEVKIPDTVKTLKVLKSVLEQCGYDYTELIAENQFDLEHPSKLQQLCRILSENITPRRRKQALGKAGWNKALQEAMLRRKFGGTASVCEKYMLEAISAFKHGETYGNFQARRLKERAAEQPTQEKHLLLPPLTMKQDEEITKNIVVFKAINETRKVLNAIIRRYGSPEYINIEVADDLGRSVSERMKLTKMMRDNEKARQKIAEKIIELGLRKEGEVKEGDIARYKLWQEQGGIDLYSGEPIAENAVLSGIYDIDHIVPFSLILDDTLQNKALVNMGANRQGKHQQVPLQYLQGEQKNRFLQNVNLLFKKGKISAKKYKYLMLPNLYDAEILAEWKSRNINDTRYITRYIVNYLTANLKFANEEKKKNVYAVKGAITSRMRKNWLNKKSWGSIDKDRSNNLHHAADALVIANLTPAYVEFASDNMKLNKIYREHHKQISFEYTDYLEKAVRKMQKYYGFNEDYARRLLEAKGRIPSIIKNLEREADIRLTDESMEFYQDKDASSFAEKVADFYRDDPQFAAGLQMPLVSYKQNKKFQGKITDDNPVKKIARKNSSLVKLDTLGNENILTASKYYCIELYETTDGKNNLRGIRYADLRKQDKKLYLTAENPADYKQHKMYLFANDYIEVINKKGECKFKGFYKSVYNINENRISCNEDNNSKSINKTIAAQDVIKKYNIDILGQIGGEVKCSAPFMLLREKK

SEQ ID NO: 8442 - protein, 1141 aa, unidentified
  REGION 1..1141: note = Description of Unknown:uncultivated organism sequence
MEKRQYRFAFDIGIGSCGWAVVSKNETGNRRIEDAGSRIFDSGEMKEGKDRKSQKRRGFRSVRRVLRRRSHRKYRLKNYLRYVHFMTDMEIRCASEASMNQILPVKVRGIDEKLTKAELLQVLIHACNHRGYKDFYEVTEIDAAESQEEEDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESIGYCRFYPEERRGFRNTALGDVYAAINALSQYRYVHTDTGEAKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFGNALKRHKFNGTSSVSYHHMADAIEAFLKGDIYGNFQWNKQKQLDEKQESQRERLLSAKVLMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLAESKRTLSYVPNLGREVDLRLGNPEGETRSEEEYRAETEMYYEGAAFVVKPHLPYVSMKVEKKFRGEIADSNPIRLVEENGIQYKISRLKVEELKREQLSKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYMKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 8443 - protein, 1138 aa, unidentified
  REGION 1..1138: note = Description of Unknown:uncultivated organism sequence
MEKRQYRFAFDIGIGSCGWAVVSKNETGNRRIEDAGSRIFDSGEMKEGKDRKSQKRRGFRSVRRVLRRRSHRKYRLKNYLRYVHFMTDMEIRCASEASMNQILPVKVRGLDEKLTKAELLQVLIHACNHRGYKDFYEVTEIDAAESQEEEDEKINQAAADRLDRSFEESHCRTISEYICRYCTIPGTDRIDYRNRFYKNENRMIIRRKHVENEIRTILKKQREWYPELTDQKIEKIMGVIFSQRDFEDGPGDASDKYRRYTGFLESIGYCRFYPEERRGFRNTALGDVYAAINALSQYRYVHTDTGEAKLSQEAAAKMVSYIMKQGSLTRTQAAKLLKPLGIAIYGSKDVDKTLAKSFRFLKEMKKIAEKCQVSWESLLSETDLTEYEEGKTSLLNQLGTVCSMYQTPHRKEEELKKLHAKWEHVHLPPAFGNALKRHKFNGTSSVSYHHMADAIEAFLKGDIYGNFQWNKQKQLDEKQESQRERLLSAKVLMQDEDVKDNPVVLRSINETRKVLNCLIRLYGAPAEIHVEVADDVARSYLERKRIQKMQRDHEKTRDAIKKKIAEILHCEESEVKGSQIERYKLYMEQEGKCLYSGRELDLEMVLDTQSHAYEVDHIIPYSLILDNTLANKALVCGNENQAKGQQTPLMYLKGEKKEAFIERVKAEKKRTSHPISNKKYDYLMLATLYGKEAKEILTGWKSRNINDTRYITKYVVGLIKNHLQFAGEKARVFGIRGHITSRFRKEWLGKNTWGSDEKCRANYLNHAADAIVLANLSKMDVEIAMDYEKLRQIRRHYGEMSIQYDHFLNHAAQRIAAFYPITEEAIRKQLAESKRTLSYVPNLGREVDLRLGNPEGETRSEEEYRAETEMYYEGAAFVVKPHLPYVSMKVEKKFRGEIADSNPIRLVEENGIQYKISRLKVEELKREQLSKLYTSDGYLIEALEKAFENKDVKTVKDYMEKEHLDVFRTTNGQPVRKVSIKGMPVSNYYKKSINETNYSILGVPKYYCVEVYTNSKGQTKIWGLRFVDMISYEGKLYMKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKK

SEQ ID NO: 8444 - protein, 1160 aa, unidentified
  REGION 1..1160: note = Description of Unknown:uncultivated organism sequence
MEKRQYRFAFDIGIGSCGWAVVSENETGNRRIEDAGSRIFDSGEMKEGKDRKSQERRGFRGVRRVLRRRKHRKELLKNYIRYIQFMSDYEIRCACESPADKVLLTKVKGLDEKLSKAELLQALLHACNHRGYKDFYEVTESDEAESQEEEDEKINQAAADRLDRSFEESHCRTISEYICRYCTIPGTDRIDYRNRFYKNENRMIIRRKHVENEVCTILKKQREWYPELTDQKIEKIMGVIFSQRDFEDGPGDASDKYRRYTGFLESLGYCRFYPEERRGFRNTALGDVYAAINALSQYRYVHTDTGETKLGQEAAAKMVSYIMKQGSLTRTQAAKLLKPLGIAIYGSKDVDKTLVKSFRFLKEMKKIAEKCQVSWESLLSETDLTEYEEGKTSLLNQLGTVCSMYQTPHKKEEELKKLHAKWEHAHLPPAFWNALKRHRFSGTSSVSYHHMADAIEAFLKGDKGDIYGNFQWNKQKQLDKKQESQRERLLSAKVLMQDEDVKDNPVVLRSINETRKVLNCLIRLYGSPAEIHVEVADDVARSYLERKRIQKMQRDHEKTRDAIKKKIAEILHCAESEVKGSQIERYKLYMEQGKKCLYSGRELDLEMVLDTKSHAYEVDHIIPYSLILDNTLANKALVCGNENQAKGQQTPLMYLKGEKKEAFIERVKAEKKRTSHPISNKKYDYLMLATLYGKEAKEILKGWKSRNINDTRYITKYVVGLIKNHLQFAGGKARVFGIRGHITSRFRKEWLGKNTWGSEKKCRTNYLNHAADAIVLANLSKMDVEIAMDYEKLRQIQRHYGETSIQYDHFLNHAAQRIATFYPITEEAIRKQLVESECTPSYVPNLEKEVDLRLGNPEGETRSEEEYRAKTEMYYEGAAFVVKPHLPYVSMKVEKKFRGEIADSNPIRLVEENGIFYQVRRKAVEELESKDLSELYTSDGYLIEALEKAFTEGEKYLNNEDDKENKKDSPKKPIKKYMEKEHIDVFRTTNGQPVRKVSLKGTPVSNYYKKRINETNYSILGVPKYYCVEVYTNDKGQTKIWGLRFVDMISYEGKLYLKDGVRPADYARHVMYLFPGEYIEVEKKGKIVYEGTYQNVYSINQGKLSIKVKNTNALKTISIGNKAGVFKYAISLNGRKSGAVKEGEAGYPCFAHCLSKKEND

SEQ ID NO: 8445 - protein, 1121 aa, unidentified
  REGION 1..1121: note = Description of Unknown:uncultivated organism sequence
MQYRIGLDIGIGSVGWAVVSAAEEGIHPARIEDFGVRIFHSGEKDKGNGTLCQERRSARGVRRLERRRSFRKKLLLNHFRNIGLAGDRFFDDLASVKDEDVYLLKVRGLDEKLSAAELYKCLVHTCNHRGYRDFYEPDETDGEDGLLASVASSFEDAYRAAAKEGRVRSVSEYILQEYKTGNFVKYRNHKDVTLLIRRGLLQEEAELLLAHQGRFHPQLTPQNQTQAVKIIFRQRDFEDGPGDPQDGSRRYQGFLENLGKCPFYRDQDRGARSTVIADVFAVTDTLSQYRFIDESTGEYVLDKAIAGELVGTLLKNASLSVSDARAILKKHGYKLQKSDNSDDKALSKAVKFLGTAKKCVEEAGMDWEELISEEQFDPDTPSTLHRIGALLSHFQTPSRRREEMKKAGIDPRLIKSFSNKKAGGTASTSYRYMIDAVNAFLNGDIYGNYQANFNRMASIEQAPERFMKLPPSVIEEAEIRDNRVVLKAVNETLKIVNAIIDIYGSPEEIVVEVASELGKSFEARGKLQKEQRTREAENDRIKKAIASLGIEEAKISQTMIDRYKLYEEQGGRSLYSDVSLGDLKDVLENRDRAYEIDHIVPFSLVLDNTLHNKALVFAGENQEKGQRTPLMYLKLKPEQKKKYLTTVNHMYARKDRQISKKKYAYLKLESIYGKEAEEILSDWKSRTINDTRYITKYIAGILDKRLVFSGEKALHVFPVKGSVTQKFRREWFRNTVWGEEEKNRDTYLNHALDALIAANLTKPYIEIGSDAMKLRGIYRLHRYQKSPEYEEYLDSCVTKMKKYYGFAEAYTRKLLSRPEYVPSYIPDLAGEVKVRFVDGVEDDVFRKGIEAFYGKDALFTVPPHKPVVSLKQARKFRGPIADANPIRVREIDGTPHRIIRLPIEELDRKKLDTLLTDDKRLIDQLRGILDGEEKYETVGKYLTGNGLSAFVSYSGQVIRKVSCLDPRSVSNYYRKELPDGGYTNLSSLKYYCVEVYKDLSGKTRTCGIRFVDLKKKDKKLYRKADSIPEGYGTHVMYLFPNDYIVIKDKGGEVKCSGFYQSVYNINRGIFYFKSINKPAIICKSIALQDKVEKRAVSILGQIGGEVRCSAPLPYIGEKSSR

SEQ ID NO: 8446 - protein, 1141 aa, unidentified
  REGION 1..1141: note = Description of Unknown:uncultivated organism sequence
MGIVIGLDVGIGSVGWAVLSVHGSQAFIENFGVRIFDSGENEKERHSNCQDRRGFRGVRRLERRRSHRKMLLTAHLQNIGLLPESFADELKACIDDDIYQLKVRGLDEKLSPIELYRCLIHTCNHRGYRDFYENAQMSEGDHAADDGINKAAARSFDADFAASSCRTVSEYLLSTHSNGAFVQFRNKQESGNEYRLIHRFMMEEEVRLILQHQKDFYPMLTQQNIDSVIRLIFNQRDFEDGPGNPNDPFRRYKGFLASLGTCPYYRTEKRGFRSTVIGDIFALTNTLSQYRYIDKKTGEFSLPSSIARELVQYALEHASLNMTEIKKILKPHGIELKKSENSDDKALGKSIRFLRTAKSCIESEGMSWEDFISEEQFNPESPSKLHRIAEALSTYQTPRRRRDELKKLGFLTDPLRKSFSEQKLTGTARTSDRYMCDAIDAFMKGEIYGDFQARTAAPDEALVTSAKYDKLLPEHIRDEEIKDNPVVFKAVNETRKIINAIIAQYGTPDEMIIETADELGRSFEERAKIQSEQKRREQDTDSVKKAIRSLMNWKEDAEVTSLQVDKYRLYHQQEGKSLYSGDELGDLSEIISDPLKKYEVDHIVPFSLILDNTLSNKALVFSGENQTKGQRTPLMFLTGDMRSDYLTRIHYLYNRDNNGNRRKNDSPSYPPVTKKKLEYLSLESIYTPEARELLETWKSRNINDTRYITKYLVGLVSRFLNFTDNSRKNVFAVKGAVTSRFRRYWLGETDWGDEEKKRDSYLNHAVDAIVIANLSMPYIEIGSDAVKLRQIYNRNHRDVSAPAYKEYFESCVKKMRKYYGFDERYTSLLLSRPDRIPSRVPKLADEVRVRTIDDDEKAFQKGIEEVYGNCSQFVLPPQMPITSHKQERKFKGTVADSNPLRLVESDGEMHKVSRKTVRELKRKDLDKIRTDDPRLLSTLHRILDGKNDNYTVQNYLTENGMTRFVTDGGQVVNKVSLEDTSDYRTYYRKQNGGGNYSNLGGLKYYCVEVYRDLDGYTRIRGVRFVDVVRKNKKLYIRAETIPEGYAAHIMYLFPGDYIVVLNTLDKSVKYQGTYKSVYNINQSRLTYYRGNSSKDSDFCLNKKDTMTKYELSLLGRKGGEIKCSAPLSLIGENESESGITG

SEQ ID NO: 8447 - protein, 1140 aa, unidentified
  REGION 1..1140: note = Description of Unknown:uncultivated organism sequence
MGIIIGLDVGIGSIGWAILSVHGTQTFIENFGVRIFDSGENVKARHSECQDRRTFRGVRRLERRRSHRKMLLTGHLQNIGLLPESFADELRACADEDIYNLKVRGLDEKLSPVELYRCLIHTCNHRGYRDFYENDQGNEDEKSDDGVNKTAARDFDSDFASSGSRTVSEYLIKSHGNGAFVQFRNKQESGNEYRLIHRSLMEDEVRLILRRQKDFYSVLTEQNIDTAVKLIFNQRDFEDGPGNPEDPFRRYKGFLAARGTCPYYHDEKRGFRSTVIGDIFAMTNTLSQYRFIDNATGEFRLPSSVAEELIRYALEHAGLSMTELKKILKPHGLVLKKSENSDDKALGKAFKFLRSAKNCVESAGLNWLDFISEEQFDIESPSRLHRAATVLSTYQTPRRRRNELKKLDFLTDPLRKSFSEQKLTGTARTSDRYMCDAIDAFMKGEIYGDFQARSAARDEVPAASAKCDKLLPKHIDDEEVRDNPVVFKAINETRKIVNAIIALYGTPDEIIIETADELGRSFEERAKIQSEQKRRESDTDAVKKAIRSLMDWKEDAEVTSLQVDKYRLYHQQEGKSLYSGEALGDLSEVISDPLKKYEVDHIVPFSLILDNTLSNKALVFSGENQKKGQRTPLMFLTGEERSDYTERVNYLYNRDNNGSRKKNNSPSFPPVTKKKLEYLLLETVYSPEAKEMLEAWKSRNINDTRYITKYLAGLFSRYLNFTDNSRKNVFAVKGAVTSRFRRYWLGETDWGDEEKKRDSYLNHAVDAIVIANLSKPYIEIGSDAVKLRQIYNRNHRDISAPAYKDYFESCVRKMRQYYGFDEKYTALLLSKPERIPSRAPKLAEEVKVRTVDDNEEAFKKGIKEVYGNCSQFVFPPQMPITSHKQERKFKGTIADSNPLRLVESEGEMHKVSRKAVRELTLKDLDRIRTDDSQLLSTLHRILDGKGNKYTVQSYLTEHSLTRFVTDGGQVVNKVSLEDTSDYRAYYRKEIGSGNYSNIGGLKYYCVEVYRDKEGYTRIRGVRFVDVVRKNKKLYIRAETIPEDYAEHIMYLFPGDYIEIYNSADKTFKNKGVYRSVYDINASRLCYYTSNIAGISNFTLNKRDIIRKYDLSILGMKGGEIKCSAPLSLIGANESESRTIG

SEQ ID NO: 8448 - protein, 1119 aa, unidentified
  REGION 1..1119: note = Description of Unknown:uncultivated organism sequence
MQKETYRIGLDVGIGSIGWAVVSSSTDGHPARIEDFGVRIFKSGEDPQKKTSLCQDRRGNRGVRRLERRRSYRKRMVKNHLQNIGLIGNGFNDELADCRDADVYKLKARGLDEQLSPAELYRCLIHTCNHRGYREFYEPSEDDDEAGMNESAANSFEKAFRESGKRTVSEYLISTASVGDYVKFKNRSGGDMEYRLIRRDLLRDEAEKILTKQSGFYRCLTRQNIERTLGIMFAQRDFEDGPGDPNDKDRRYQGFIEKLGKCPFCKDEDRGFRGTVLSDVFAVTNTLSQYRFVSKETGEYCLDKNVAEEIVDYLLQNAKLGISDVKRILKSHGFELLKGEGSDDKALGKALKYLPMAKKCVEEAGFDWNEIISEDQFDFEKPSLLHRIGELISMYQTPRRRREEMRKAGVDDKLIKAFSCRKVSGTSSVSYKYMTEAISAFLDGDIYGNFQANYNKNAEENAPVKREIKLLPSHIDDPEVRDNRVVFKAINETRKIVNAIIDVYGSPEEIVIEVASELGKSVEMRNKETRRQRNNEQANDKIKEEIASLLKIDVGDVKPVMTERFKLFREQEGKCAYSGKPLGELKEVIDNRDKKYEIDHIVPYSLILDNTLNNKALVFAGENQKKGQRTPLMYLGAEDAKNYIAFVNHMYSRKENPISKKKLDYFKLESIYGEKAEEILGGWKSRNINDTRYITKYIAGLFERNLIFTGEKKHHVQTVKGSVTQKFRREWFRGTRWGTDEKSRDTYLNHALDALVAANLTRPYIEIGSDALRLISIYKSHRNTVTPEYDEYLGNCVSKMKKYYGFDEEYTRRLLSRTGRVPAYVPRLSDEVSVRFWEGDADKFEENINRVYGNEAPFVCPPHIPVTSHKPEKKFKGEIADSNPVRIVEIDGVPHKIRRVDIKNVGEKTLGKLYTGDPVLKERLEEILLGKGEKYTVETYLGETGEDYFTDGKGHVIRKLSVDDGPVSNFYRKDNGDGNYTVLGMLKYYCVEVYKDKEGNTAVCGVRFVDVSKKGKKLYRKAESIPADYAEHVTYLFPGDYIRVIDRKGKLKFEGYYVAVYNINQSVFYCRVGNMSDTVAKSISRRDTVTKVYVDILGKIGGEVKCSEPLPCIPEKRSR

SEQ ID NO: 8449 - protein, 1112 aa, unidentified
  REGION 1..1112: note = Description of Unknown:uncultivated organism sequence
MTYRIGLDIGIGSVGWAVISGSKEGAKIEDFGVRIFDSGESNGGKDRKSQDRRHHRGLRRLIRRREYRRMILKNHLLQIGLLDKRFEEKYDEIRNSNVYELKVKGLDEKLTPEELYKCIIHFCNHRGYKDFYEDSDEQDDESGKNKEAVRTFDKLFEESGYRTVSEYVLNEKKGPARVEFRNRDSRKGTEYLLIHRFLLKDELSLIIKKQQEFYDCLKGQNGEFIVHAVFRQRIFEEGPGNPENPYRRYTGFLETLGQCPFYKEEKRGFRATVISDVYGVVNTFSQYRYKNLESGELEISKELACGLIDSFMKNGSISVAEAKKIAKAHGYEMMISSNSDTGSLQKAQKYIKPMKKIVEEAGENWEDLINENQFDLKKMSLLNRIGETLSKYQTPSKRKEELKKLGISDEFMKALSVKKFGGTSAASYRYMVEAIDAFKNGEVYGNFQAGFLKSQKEETENPKSIKLLPKHIDDEDVKDNPVVFRSINETRKVLNAIIEVYGSPEYINVEVASDLNRSFEERKRIQKEQRDREKARDKTRQNIAELISISVEEVTERQIDIFNLYAEQEGKSLYSQMPLGDLKDILEDRSHVYEVDHIVPYSLILDNTLNNKALVYASENQMKGQKTPLMYLSGEEGKSFLAFVNALYLKKNGISKRKYGYLTLKTLYGNEAEEILRAWKSRNINDTRYITKYIVAMLNTHLLFDGNHKQHVYGVKGAFTSRFRRVWLKGSVWGEEEKNRESYLNHAVDAIIVANLTPAYLEIASDNIKLNQIYRRGRKTKTTAYYNYLESCLVKMEKYYGFNRSYTQKLLELRKSVPAYLPDVKGEIETRTADNEDELVKRVSEFYGSDVSFVVPPHVPIASIKPARRFRGTIADDNPIRIEDIEGEKYKIVRKEIKKITKKDLDKLYTTDADLLSTLQRILKDTKDQYSIGDYMEDNQMSVFMTDKGTKVYKVSVREANKVTNYYKKNIGDNNYTNMSMLKYYCVEVYKNKKGETKTWGIRYVDIIKRDKKLYLKKVMLPEDYAEHRMYLFTNDAITVYNKSGEKKYEGFYKSVKNINRSSFYIGDYIKDEVKPEQINRTDTVKKLDISILGKRGGGIACSAPLSLTPEK

SEQ ID NO: 8450 - protein, 1120 aa, unidentified
  REGION 1..1120: note = Description of Unknown:uncultivated organism sequence
MKYRIGLDIGIGSVGWAVISAEEAGHLARIEDFGTRIFDSGEDPQTSESLCKQRRGFRSVRRLTRRRRFRKELLKNHLLNIGFLNATFEDELAECLNVDVYQLKLKGLDKKLSPAELYKCLVHTCNHRGYLEFYEPEESDKEAGENLRAANRFESDFSASGKRTVSEYLLDSFSVNGFVKYRNRSGGDVPHLLIRRDLLKQEIRQILLCQKQFYPCWNENNIDRALEIIFAQRDFEDGPGNPDDPTRRYHGFLETLGKCPFYKGDLRGFRGTVISDVFAVTNTLSQYRFCNVETGEFSLEREVAKEIVDFLLLNGRINLTDVKKILTAHGFKLLKSDLADSNALGKALKFLPLAKKAVEESGESWEHMIAEEQFDVTVPSRLHQIGELISKYQTPRRRREEMKKAGVDPRLIAAFANKRISGTASCSYRYMCDAVSAFLNGDIYGSYQANRIQSDAEIDPVVKSVKLAPSAIDDPEVRENRVVFKAINETRKIINAIVDIYGSPEEIVVEVASELGKSVEARDELLKRQRANEKENAEAKRVIAELLDIEATKVSSSMIERYKLFVEQEGKSAYSQKPLGELKDVVENRDRVYEIDHIVPFSLILDNTLNNKALVFTEENQKKGQRTPLMYLGSAEQKSFIAFVNHLFARKKDGISKKKYAYYRCETLYGQEAEELLNEWKTRNINDTRYITKYVAGLIERHLLFAGDKKQHVQTVKGSVTQKFRREWFRDQRWGSDEKDRETYLNHALDAVVAANLTRPYIEIGSDSLRLLSIFKRSRGRYTEEYDEYLEKCVSKMKKYYGFDEDYTRKLLCRAGRVPSFVPRLAEEVAVRFVVDREEKDDKSFCEEVNAVYRLDSEFIVPPHFPITSCKQDKKFRGAIADSNPVRVEMIDGVPHKIKRTDILGITPDDLAKLYTTDASLRAGLVEILNGKDKNYTVGKYLAENGLTHFTAPDGTVIRKVSLDGGAVSNYWRQELGNGNYTNLSMLKYYCVEVYQDLDGKTRIYGIRYVDMIRRNKKLYQKAESYPSDYGKHETYLFPNDYVQILNGKNEVKFEGYYRAVKAIKQCQLWFRKPNSREMVKKSIASNDRVSRVDVSILGKKGGEICCSEPFPSIGEKESR

SEQ ID NO: 8451 - protein, 1123 aa, unidentified
  REGION 1..1123: note = Description of Unknown:uncultivated organism sequence
MTRKYRFGFDIGIGSTGWAVLSYTNNDDVRIEDVGVHLFSSGEDPQTSKNLNQTRRGYRGVKRLIRRRHYRKIRAKNYLVKIGLLSAQELQLATEKNGNQNIYAIRLKGLTEKLSKLDILNCVIHICNHRGYNEFYEEDSSDTEDAGKIQEGLANFEQIYSSKGYKSVAEMILKDDVFKAHMPFPDYRNRKNNGRYILLKRKYLKEELTNILRHQQQYYQKQLTNANIEFLVNEIVFAQRDFEEGPGDPDDAKRKFKGFLDSMGQCMYYKDQQRGFRSTVISDLYSLVNSLSQFSYVNKETGEIYLPPKAAKEILQTALLNGCITEADVKKILNKFEIEIIKSSKLNETIPDTVKTIKILKNMLSDAGYSWAELINEDQLDLDKPSKLHKLCVLLSSNITPHRRNKAMKVSGWNDKLQEAAKRKKFGGSASVSYKYMIEAIHAFENGETYGNFQARRMNELESRAEKHLSKVLPPFTLTEDEDLVKNTVVFKAVNETRKVINALVRKYGSPDYINIEVANDLGRSLIERREIEKRQNDNRKTKEKIIKKIAELRLGGINSEADVKGAMIERYKLYQLQNEHCLYCGSPIKLERLLTKDYEVDHIIPQSLILDDSLENKALVCAACNQKKRQQTPLQFLTEEQGKEFLKTVSELFRKKKISSRKYKYLIQPNLYDGALLDEWKSRNLNDTRYLSKYISNYLQNNLEFANTKGKNVYSIKGSITSRMRRVWLNKKTWGAEVKDRETSALHHAADAVVIANLTPAYVEIATDNLRLIRIFKAHNKVVDTEYTEYLNACVRKMKKYYGFSENYTKNLLEHKDRVPSFVKNLRDEIDIRLPSEEIEDIVFKANVNSFYSADTSFAKTITRPLVSYKQDHKYKGALTDDNPIRIKEVGGSLVKVTTKSIRDLDSGSINKINSNDTELKSALDDILNKQIDEDGKKYKNIDAYLKKKNLDTFVLPSGRLVRRVSMVGTKVENVFKKVISENNYTAINANKYYCIEVYKTKKGKVNIRGIRYVDLVKKDKKLHLRISYPDDYQQHVTYLFANDYVRIFDVVSGMQKFEGYYKSIKTIGRKQLYFTKNNRQQTDIITINQTDDVKKFVVDILGKIGGEVKCSVPLPLLVGKQ

SEQ ID NO: 8452 - protein, 1123 aa, unidentified
  REGION 1..1123: note = Description of Unknown:uncultivated organism sequence
MTRKYRFGFDIGIGSTGWAVLSYTNNDDVRIEDVGVHLFSSGEDPQTSKNLNQTRRGYRGVKRLIRRRHYRKIRAKSYLVKIGLLSAQELQLATEKNGNQNIYAIRLKGLTEKLSKLDILNCVIHICNHRGYNEFYEEDSSDTEDAGKIQEGLATFEQIYSSKGYKSVAEMILKDDVFKAHMPFPDYRNRKNNGRYILLKRKYLKEELTNILRHQQQYYQKQLTNANIEFLVNEIVFAQRDFEEGPGDPDDAKRKFKGFLDSMGQCMYYKDQQRGFRSTVISDLYSLVNSLSQFSYVNKETGEIYLPPKAAKEILQTALLNGCINEADVKKILNKFEIEIIKSSKLNETIPDTVKTIKILKNMLSDAGYSWAELINEDQLDLDKPSKLHKLCVLLSSNITPHRRNKAMKVSGWNDKLQEAAKRKKFGGSASVSYKYMIEAIHAFENGETYGNFQARRMNELESRAEKHLSKVLPPFTLTEDEDLVKNTVVFKAVNETRKVINALVRKYGSPDYINIEVANDLGRSLIERREIEKRQNDNRKTKEKIIKKIAELRLGGINSEADVKGAMIERYKLYQLQNEHCLYCGSPIKLERLLTKDYEVDHIIPQSLILDDSLENKALVCAACNQKKRQQTPLQFLTEEQGKEFLKTVSELFRKKKISSRKYKYLIQPNLYDGALLDEWKSRNLNDTRYLSKYISNYLQNNLEFANTKGKNVYSIKGSITSRMRRVWLNKKTWGAEVKDRETSALHHAADAVVIANLTPAYVEIATDNLRLIRIFKAHNKVVDTEYTEYLNACVRKMKKYYGFSENYTKNLLEHKDRVPSFVKNLRDEIDIRLPSEEIEDIVFKANVNSFYSADTSFAKTITRPLVSYKQDHKYKGALTDDNPIRIKEVGGSLVKVTTKSIRDLDSGSINKINSNDTELKSALDDILNKQIDEYGKKYKNIDAYLKKKNLDTFVLPSGRLVRRVSMVGTKVENVFKKVISENNYTAINANKYYCIEVYKTKKGKVNIRGIRYVDLVKKNKKLHLRISYPDDYQQHVTYLFANDYVRIFDVVSGMQKFEGYYKSIKTIGRKQLYFTKNNRQQTDIITINQTDDVKKFVVDILGKIGGEVKCSVPLPLLVGKQ

SEQ ID NO: 8453 - protein, 1140 aa, unidentified
  REGION 1..1140: note = Description of Unknown:uncultivated organism sequence
MASGVRIGMDIGIGSIGWCVISGRKETAKIEDFGVRIFDSGELSKYGTNGQNRKSQERRGFRAARRLIRRRYYRKNVIKAHMQNIGLTTAEKISAFYEKNRRDIYEIRARAVKARVTPEELAACLIHVCNHRGYRDFYEEAEKEATGGYHNIKDKQPDEKADAEEAKNKQALAAFDRLFVDSNCTSISQFIVRQFKNDNDKYPAIRNKETNDTRYLIRREYVRDEISKILDTQASFYPCLSRANIDMALKIIFSQRDFEDGPGNPKDKHRRYTGFLATIGKCIIYDQDRGFRSTVMADVFAVVNTLSQYRYVDLNTGEFTLTSSAAAEIIQHLLSNGNLTMKDVKNILKKYDLKLMKGDNSDDKALSKAVKYLKTARKCVEEAGLDWQEYISEPQLDCENYSRLHRLGVVISKYHTPARRRKELRKLDFATDKLIDAFAGKKISGTSNVCYQYMCEAAQAFLNGEIYGNFQAEKIKAQKNAVETKETKKYLLEPIEDKEIINNPVVFRAINETRKVLNELIRVYGSPEYINIEVAGDLNRSLIDRWNIKKLQDENEKRSIRDKQRIAELLTIPADEVRGVHLDKYRLYEEQGGKCLYSGAPLGDLQEVLTDRYGRFEIDHIVPYSLILDNTLHNKALVFARENQIKGQRTPLMYLNPERRANYLAFINVMYSRKENPISSRKYQYLKLDDLYSKNAEDLLGNWKSRNINDTRYITRYIVAYLKKKLIFSGHKAEPVYGIKGGLTSRFRKIWLNKKTWGGDEKDRGTSHLHHAVDAVVIANLTPAYVEMASDNIKLQQIFRRTKNTANPEYQQYLDSCIRKMKKYYGLSEDYVRVLLTKTQKVPSYIPNIRDEVEIRFNDQDEELWQGQIISFYRGKGDFVRQPRQPLVSYKQERKFRGTITNSNPIKTRDIDGELKEIKRVKIQELSRSKLECIRTGDRSLIASLEKIFSGKDDKYTVGKYLKDNGLPYFVTEQGQRINKLSVIGRTISQPYRKNIDEHNYSLLDANKYYCVEVYKNLAGKTCTWGLKFVDLVKNDKKLWLKPGSLPSDYGKHITYLFANDYIQIFNKKGEVKFEGFYKGVYNVNQNSFYYAKGNEPRKTGKSITIARHDTVKKYHIDILGRQGGEIKCSAPLSLLTENP

SEQ ID NO: 8454 - protein, 1340 aa, unidentified
  REGION 1..1340: note = Description of Unknown:uncultivated organism sequence
MQKFFLGLDIGTDSVGIACTDEQYRLLRARGKDLWAVRLFDPANDAKQRRSYRTLRRRIARRKERIALLQEIFAPVLEDANFFLRLKNSALYEEDKEEGLPRFTLFADENYTDKHFYAEYPTIFHLRQALIDRGAADLRLYYLALHHIIKYRGHFLFEGDSVGGAQNVSKLFERFNAVSEELLEEPLRLPEACAGDFLRIAAGGGSVNDKKRALGELFGTSPAMKEIAVFLAGGKGKPQKVLGACEEGSFSLEIPDEEFEAKAETLGDGFALFEALRNIFRFTLFEKVLGGNRTISQAMIAIYKKHKSDLKSLKKLLLFYSHELYVEVLKSAKETANYVHYIGYTKPNRKKIHVAKCKTYEEFSDYLLRKLATPPADEEAHALWERVTAELREGSFLPKILHADNGTFPHQINLAELDAILSNLCRDFPVFAEKDGDGLSPAEKIRSIFKWRIPYFVGPLNPHGPNSWIVRKEGRITPWNFEEIVDLEKSNEGFIRRMTGKCSYLIAEDVLPKCSMYYQAFDVLNQLNKLRINGELISVALKQELFRELFCTSPTVTDKRIAAYLVSHGYAEKGERIVLTGKDGDFRAGMRSYCTLKKKLGSLVDEHPEVCEDIILWHTLCTDKSMVESYLLKKYGDIPAIKENIKWIKGLTLFKDFGKLSKKFLCGLYGGEDPVTQAQYTILGELYRSNNNLNELLFGEKYRFQEAILAENGAGSGEVGYDDVQALYVAPQVRRGIWQALRMTDECVAALGRAPDKIFVEVTRNDDPNNKGKRTESRKAQLLALLRDVKDIEKLREELKEKTDRELRSERLYLYFRQLGRCMYSGKKIDLGQLGSDLYDVDHIIPQSLTKDDSLDNKVLVLRTKNKEKSDIYPLPAGFSDRQPFWKFLYEAKLISGEKWARLTRTNPLTDEDYEGFVNRQLVYTNQMAKAAAELLQRKFEASGTKIVFSKASRVSEFRQKFRFTKCRETNDLHHARDAYLNIVVGNVYDTRFSSLRDYFRRKEADGTQRAIRLDTLFTYSVAGAWDKDSSLAVVRATMARSSMAVTRYPLVGKGMFYDETVYPHEDAGIGVPRKGKGPLSDPAKYGGYKSLKTAYFAIVASAGKKGKPQKTIEAIPVLIDYAARNDPEKLPAYLREKCGLREPKLLVPLLRVKSLVKVNGTPAWLAGITGSRIILHNAAQWFTDEKTDAYVKALAKLLERERAGEYSAEEKAQEVFPMHVNRLGEVKQTVDRAQNQALYDLMLRQLGKPVYGGISGAVSFRNTLNSRREQFAALPVLKQAKVLIQIAKFLKCNAESADLTELGEGANCGLLRVGKNITDVDFRIVDQSPCGLSIRERKV

SEQ ID NO: 8455 - protein, 1339 aa, unidentified
  REGION 1..1339: note = Description of Unknown:uncultivated organism sequence
MEKFYLGLDIGTDSVGIACTDENYRLLRAKRKDLWATRLSDPSSDASERRKFRTARKRISRRKERITLLQELFAPYMTDEQFFLRLKYSSLYLGDKPDGFPRFTLFADGGYTDREFYAEFPTIFHLRQRLIDCGSTDLRLYYLALHHIIKYRGHFLFDGSYSVGKRDLSALFEEFNFVAAQLSDAAPVLDVNLARTFLDIAVDPIKGMTDKKRELQKLFGESRSMKAVVTFVLGGKGKPSDIFEDCAKESFSLDMPDEEFDSLAETLGDTFALFESLRKIYKFIRLEKIFSGSKTLSQAMTGIYDKHKSDLADLKRLISKYYSHDLYCEVFKSTTQGANYVSYIGYTKPSRKKIKVKKCTSYDEFAKYLLKVLKTPPEDVEGRALWEKLTGELNARTFLPKILNADNGLFPHQLNLDELDKILSNLCRDFPAFGVKDGDGLTPAEKIRSVFLFRIPYFVGPLNPHSPNSWIVRRRGRITPWNFEKMVDLEKSNEQFIRKMTGKCSYLFDEDVLPKCSMYYQAFDVLNTLNKLRINGEPVSIRLKQELFNNLFLVEPRVTDKKIAGYLISHGYAGKGERLELSGKDGDFKASMRSYITLKGKLGEFVDRHPEICEDIILWHTISTDKSLVEAHLLKKYSAYREITENIKWIKGLTLFKDFGRLSLEFLTGTEGGEAPDGRKYTVLSELYRTNFNLNEILFGERYSFSKAIAEHNGVNDGEVGYSDVQELYVAPQLRRGIWQSLVMVDEYVKALGRNPDKIFVEVTRQPSGDEPKRRTVSRKEQLSALLETVDGIDDLKNRLKERTDGDLKSERLYLYYRQLGRCMYSGASIDPLKLNSDLYDVDHIVPRSLVKDDSLDNKVLVLRSKNVEKSDIYPLADGFSDQLPFWKLLREKQLISDEKWARLTRREPLTDEDYEGFVNRQLVYTNQMAKAVAELLNRKFGASGTKIVYSKAANVSAFRDKFGVPKCRLTNDLHHARDAYLNIVVGNVYDVRFTRLADYFRRRESDGSQRRIDLDKLFTYDVPGAWDSSSSLSVVLSTVARTSMAVTRYSFIDGGEFYNQQPCGKKDGGIGAPLKGKGAVSDVLKYGGYKSLTTAYFAIVRSKDKKGRTIKTIEAIPVLVDYNAHKDVQKILTYLKEKCGLADPELLVPCLRKKSLVRINGSPAYIAGITGSQIILHNAVQWFADKKTDEYVKALGKLLDSEKTRKSEDLSDEVFVMHTNRFGEVKLKIDREQNLELYQKILKQLSKKIYGGISGAVHFRAVLQNAENKFASLTVFGQSKVLIQILKFLKCNAETSDLTLLGEGGRCGTLTINKNITDLEFSVVHVSPCGLDEKERKI

SEQ ID NO: 8456 - protein, 1339 aa, unidentified
  REGION 1..1339: note = Description of Unknown:uncultivated organism sequence
MKKFYLGLDIGTDSVGIACTDENYNLLRAKGKDLWAVRLFDQSNDASERRSFRTARRRLARRKERITLLQEIFAPHMQDEKFFLRLKSSALNIEDKPDNLPKFALFADEGYTDKQYYAEFPTIFHLRQKLIDGGSADLRLYYLALHHIIKYRGHFLFDGSYSVERRNLSALFAAFNAVSAQLFDDAPLLGESRAEDFLNIAIDSTKRMNDKKRELAILFGDSRRMKAIATFLLGGTGKPSDIFDDCDEKSFSLDIPDEEFEAKAETLGERYELFESLRKIYKFVRLEKILDGCQTLSQAMIKIYDKHGSDLAVLKELIAKYYSHDLYCEVFKSTAQKANYVNYIGYTKPSRKKINVKKCNSYEEFAKYLLKVLATPPAAAEGRALWERVTGELEAGSFLPKILNADNGLFPHQLNLEELDKILSNLCRDFPAFGKKDSDGLTLAEKIRSVFLFRIPYFVGPLNPHSANAWIVRREGKITPWNFGEMVDFEKSNEGFIRRMTGKCSYLFTEDVLPKCSMYYQAFDVLNQLNKLCINGEPISVQLKKELFGNLFLKDPRVTDKKIIGYLISHGYARKDERISLGGKDGEFKANMRSYVTFKSKFGDFADQHPEICEDIILWHTISTDKGMVERYLLKKYSAYSQITENIKWIKGLTLFKDFGRLSYKFLMELQGGEDPAGGKFTVLSELYRTNLNLNEILFGEKYSFREAIGEYNGVRDCEVGYNDVQELYVAPQLRRGIWQALLMVDEYVNALNRYPDKIFVEVTRQPSSPEAQRRTLSRKEQLLSLLETVDGIDDLRRELKEKTDGDLRSERLYLYYRQLGKCMYTGNRIDPLQLNSDLYDVDHIIPRSLVKDDSLDNKVLVLRSANREKSDIYPLSEGFTAQAPLWKLLREKQLISDEKWARLTRRNPLTDEDFEGFVNRQLVYTNQMAKAVAGLLERKFGDKGTKIVYSKAVNVTEFRHKFDIPKCRETNDLHHARDAYLNIAVGNVYDVRFTRLSDYFRRRECDGSQRRIDLDKLFTYDVDGAWDKNGSLAIVRSALSRTSISVTRYSFIEGGAFYNRTVYPKDDGGVNAPLKGKGAIADFKKYGGYKSLSTAYFAIVRSKDKRGNHIKTIEAIPVITDYVAHGDKDKVLRYLTDKCGLIEPELLLPCMRIKTLVKVNGFPAYIAGISGSKILLHNAVQWYTDEKTDRYVKALGKLLEREKKGEIVNAGDEVFVMHTNRLGEIRFKIDREQNEDLYEAILHQLSKKVYGGISGAVYFSSTLQNKADKFKSLTVLEQAKTLMQIVKFLKCNAEAANLNLLDEGSACGKLGINKNITGVDFEVVHSSPCGLDEKVRKV

SEQ ID NO: 8457 - protein, 1404 aa, unidentified
  REGION 1..1404: note = Description of Unknown:uncultivated organism sequence
MGLILLVKKNKAEWYLGLDIGTNSVGFSATDLEYNILTKGGKLQCGARLFKDAQDASTRRLFRSTRRRMARRKVRIDLLQEIFDPVVSQKDASFFIRLNESDLHLEDKSVKSDYPLFNDKGFTDKEYYKKFPTIYHLRYHLLNNEEKDIRLIYLACHHLIKYRGHFLFPNFNTNRGCSGFENKLKEINEFLLEQSFEKLFVENNLENSLDSIINDKSKSDKQQWDEIKEKLNPTNDKKLNSVFTAIRGNKISLSKIWEDLDEAEKEIKEELKDFKFSSDKYEECLIHAEEILNDDQLTLLELLKQFYDLIQLNRIVAGSSSIAEAMVHRYEEHKADLKLLKKFIKTHLPDEYDKMFRKNIDFVDKGHIHASYVNYVGSNITHNRKSTSHSTMCVDKNKEPVTADYSDFLKYTKALLEKAGNVAKTSEEYLILLDKIEQESLCKIHNTQENSYIPYQLQEAELKAILKKQQNNFEFLKKEAGKILSLLTFRIPYYVGPLNEAHKDIPDKFAWIEKLPGFEKQKVLPWNFEKVVDAAKSGENFITRMTAKCTYLPSEDVIPKQSLLYQKYMLFQDLNNLKINGNRITQDLKMFLYNSICQKETSLTKTKIKKHLENHGKITKKDSVGKENENDLAFNSSISSYIKLKNIIGNSMNDEMCENIIKWHTVFGDEKRPVQARIKRQYGKELSEEQIAKLSKLSFKGWARFSSKFLNGITTTDQTTGETGLTIIKILEETTQNLIEILNSDNYFEKFQDIVEKEMQKLRREEIDYGYVSDLYCSPTVKRSIWQAVLISKELMKINGGPPSKVFIEVTRGTDKKQKGKMKSSRRKQIENILDKMPKETSDLTTLKRELAQKKDEKEFRSDRLFLYFTQLGKCMYSGEKIELSDLNNYNLYDIDHIYPQSKIKDDSLTNRVLVKRSANAHKSDTYPIEYSIQKERKDFWSFLRSKNLITNEKYNRLICSQPLTQSIIGGFINRQLVSTNQAVKETTKALRILFGFSTDSRKIVYSKAANVSEFRNTYDLIKSREVNNLHHAHDAYLNIIVGNVWDSVYGRYWSDNFTFNENNALDRLFKYDHKEAWKVSYIEKIKAYLFDNKKYLDKFLITTRPFEKKGEFYDQTIHPKGKAQFELHKGYDTEKYGGYKNANTAYNCLIEYDGKKDERVRGIFSVPVRFAHLKTNELLAQIAEENGITDKKPKVLMPKIQLFSVLEVDGIRYHMRSGISDNKLQCSVTVEWYPDKDIIQIVRDIFKFKKLIDDKNFSKETVEEWKETPHDIEFATRERNKNIKEGKKISRENNLKLYDAIIEQIKKPFYQNYPTGKKVREEKILREKFEILKTFSQMEQLVELLNVITMNKANADTTNIGGVKYDECKYKISGCNNVTSKNIILITQSPTGLFENKIAINLK

SEQ ID NO: 8458 - protein, 1386 aa, unidentified
  REGION 1..1386: note = Description of Unknown:uncultivated organism sequence
MKKQNNYYIGLDLGTNSVGWAVTNEKYELLHLKRKPAIGVNTFEKAKTAEQRRNYRSTRRRLARRKQRVLLLQTFFAEEVAKKDPTFFLRLNNSPYFKEDKHHSLQDTKFSLFNDKDFTDKDFHKKYKTIYHLQNDIISQPDKKFDIRLVYLAVHHLIKYRGNFIKQDENINVAEFTNSLVTDAFQELAHYFEDTDLIAAQNFFVNENVRKYEAIVSDKTNGGLKRATDKIFEQFEIKDKTLKTLLSLALGKVTRLNQIFSDEIVDDEQGKITIDFKSISYEEKYNDIKTVIGEVNIVLIDELKRLYDYFVISRLMDGKTLVAEAMVEKYEKHRSDLALLKKIFREHASKEDYRKVFTTLYTTDDKGKKKVITDVNYPRYIGKKSPYVIVKKGDYADFKKFLNKMFKDLGLLSLNDVIKVQEGLDDETFLPLINSKDNATIPYQFNEYQLRLILENQSKYYKFLNEKVDESSLTTLEKIMSIISFKIPYYIGPLVAEDNHPFAWVKRKSFEKVTPWNFSDVIDEATSASRFIERMTNKCTYIPTEDVLPREAILYQEYLALDVLNNLKINGEAIDNYAKQTLLTALYSNKTPLTKKRIATILAKNKNDVVAVSGIDDDVKLAFTSLHKFKAILGENQDLTIEDMEKIIFYRTIFTEQKMFNKKVDELLGHRLSEELCKKIKQLKFKEWSRFSNAFLTGFSKTLNKPVLFDEKTGEVISIIDIMRNNVLSLQQVIHHEKYGVLEALNKYNESMKTNENAFEDVYNLYLSPSVKRPVIKAIHLVDEIIKANDNKLPKKIFLEVTRHDDFARKGTKTISRKKQLDDLYKIAVKESKDLKDLMDELNKKTDADLRSRKLYLYFLQHGKCLYTGNPIALENLVMGDYDIEHIIPQSLITDDSLNNICLVESNINKAKGDVYPLPRTIVNVEKMKPFWERLMKRGFMSESKYQRLIRMSELTEEERFSFINRQLVETSQANKAVAKILEDRYGKGSVVYSKAQRVSDFRHKFKLLKQRDLNKAHHAHDAYLNIVVGNYNDAQTRLAYINKQTGKNFKFNPATAFEEKSFLDVWDKKSNLATIKAVLSRKNILFTQGTYISKGEFYDQQLSPAGEGKLTPVKESGPLSDTTKYGGYSSLNTSHFALVEIPKKRGSERRLIQVTRLHFAKIASGKMTLEEYLITYVGLENPKVIIDVIPLNSLIKRGKTIRSISGFDSGNTLIAHNHQEPFFSKDIEDSYYYLNRYLREIELREKEDTELLTSNEPYTIIIGNRNEKEKVQKIVISKESNEKTYLELAMHFAKDIYEHIFRGVNDTLLSNLDNFKTKSIYEQANIIKQLVMLLQTGALPASINLTSVGLNKSINRNRNINLIEKGDKLLIQSITGLYDKEICLA

SEQ ID NO: 8459 - protein, 1386 aa, unidentified
  REGION 1..1386: note = Description of Unknown:uncultivated organism sequence
MEKKFYLGLDIGTNSVGWALTNENYELVHLRGKSAWGVHLFEEAKTAEQRRLYRSARRRKARTKRRINLLQELFAKEIVKVDPLFFIRLNNSTFFAEDKDKMLLGRKDSLFSDTKFSDKDFHKLYKTIYHLQKELIEDKKTKFDIRFIYLAIHHLMKYRGHFVLEDQDINVDQFGIHQIEEGFEKLKDFFALDLKTKELFNNENISGFYKVVEEVRGVNNTKRALRTLFETKNKLVNNILDFIASGESKAGKLFLNIELNEEDEQLPINLSSDEYENQYNVIENIVGEEVIVIDAAKQLYDYMIVARLMDGEKFIAHAMVRKYNKHRDDLKKLKKVIKEFCGQEEYNSFFKDEKAKDNYCAYIGMTKIKGVKKSVNKITSAKEISDFYKRIKSLLVNVESRDADEIREDIEKGIFLPRIISVDNAKIPNQFYAYQVDKILQNAKKHYSFLNKIENNLTIKDKILKILTFRVPYYVGPLSDLNNVNLTKGGFSWVVRKTNETVLPWNMDKVIDLDKTAEQFILNMTNKCTYLIGEDVLPKQSLLYEEYNILNHLNVIKINDNRLTKEEKDELIENVFKKRVNVTYKAINDYFTNRLKKDVKVTGFDVDVKISLSSYHKFNKIFKDRINNEPQNAELIRNLERVVLLGTIYSSPSDFAKRVKNNIQFKEFFKEDELEKISRLRFNGWGNFSRLLLAGYDSTSKTIAPNQSLTYKDEKTGNELSIIEIMREEPLNFNEVLYHEKYHFNDLIKRLNENKDETLDVDELIDSYYLSPAVKRSIKRTTKIVDELIQINDGIIPDKIFVEVTREDEAKRKGKGRTKSRLENLRAIYKNAIKDADEYRVLAKQLDNQSLDDAYLRPKKIYLYYLQNGKCAYSGEPLDLTKCDIDHIVPRSLVKDDSFNNLVLVKEEENKLKGDKYPIRMDVIRKQKPFWNQLRKNGLMSNEKYEKLTRTKELTDEDLQGFVNRQLVVTNQANKAVAEILKKLYGNATIVYSKASNVTDFRQQFNIIKGREINNVHHAHDAYLNIVVGNYFHTRFGSRYYYAKAKDKKWNPKKVFTYSISGCWDKERDISTIKKMLKRRDVLFTRMPEIRSGEFYDQNAIKANDGLIPIKEKGPLSDTSKYGGYSGKTAAYFTIVEHTIKNKRERILVSMPIIINQKIKQGHTTFIEYLENVLNLVEPSVLYSPIPFNTVFKRGQSLQYLTGSTGDFYQIIMRNMIEPYFDEFTFEYLCLIYKYFEQLEIRSNRKKMNENEMQSLKEIQVIFSSNEKRRQNENRLRFITLEKNKIVFENLIKQIAKPIYEKSFGKRRDIIISNKDQFYKLGLERQIEVISNLHRFIKSGVPGRIDLEELGVKSGNLTMNYKIEDLSIIKQSITGLYQKEIIIKQV

SEQ ID NO: 8460 - protein, 1334 aa, unidentified
  REGION 1..1334: note = Description of Unknown:uncultivated organism sequence
MKKFYIGADIGTNSVGVACTDESYRLIRAKSKDCWAVRLFDEGETAFDRRTKRTARRRLARRKQRINWFQELFEPFIDDKTFFIRLNNSQYLPEDKDSLLCGNKNNLFENEGEESKFYKKYPTIYHLRKALMDGGNFDIRLYYLALHHIIKYRGHFLYEGSIEDIRDFSNLMKGLDCAIADSYDGGLNLFDSVDSAKVRDILIDKKSGLRDKQVELEKLLCAKSKREKEILKGITGQKISPYVLFGDEFKEEKSFSLNDMSDEEFESKRSSYGESFTLLDLMHSVCNYVKFEKIFEGHSDISSAMISVYEKHKADLVLLKKVVRKQSKEDYNKIFRSVNEEKNYVNYIGYTSKDGRKIKVKKCKDEDFFKYLKKYLNGILNEDNFDIVSKIIKEIDDRIFLPKILHSDNGLFPKQVNEFELKKIIENMVRNYAETEEMASAVLSLFNYKIPYYVGPLTGCNSWVVRTDEKVTPWNFDRVVDLAKSNEAFMRRMTNKCAYIKGEDVLPKASIIYQKYDTLNQLNKLRINDRVISIELKQTIYNELFLKYPKVTDKKIKELLVREGLCSSSETKDITISGKDGDFKSSMSSYIRLKNILGDFVDDDLKSGGKVCENIILWHTLNTDKKIVEDLIEKNYGFIPEIKANIKQLKGLTFNDFGRLSAKLLIGIEGVDKTTGQILTILDVLYQTNQNLNEVLNNESYNFSEIIDEENGIETEIISYETVEELYVSPAVRRGIWQTLLMIDEYVNAVGRQPDKIFIEVTRNDGKKGDNGRTQPRKRQLQEKFKNIGSAYSDIIEELSEEKYTDLKLRQERLYLYFRQLGRCMYTGERIILDELNGNRYDVDHILPRTYVKDDSLDNKVLVCRGANATKADTYPLPTEFSRKEVRAHWKMLLDKDLISKTTYDRLTRIEPLKDDDYNDFINRQKTITDQTAKAVIELLKRKYPNAKLIFSRAKNVNDFKNRFNLFKCRETNDLHHARDAYLNVVVGNVFDSVFSTPLGQSRKDGDVWRIYNLKKLFTRDVIGVWSKDSIKVVKDTYSKPSMSVTRYATCNKGKFYDETVCRKDDSAITAPRKGKGPLSDVTKYGGYTTQKTAYFAIVTSVDKKGKSIKTIEAIPVLVTYKLKTDTNAIQKYLESYLREPIIVIPKVKVKQLVSYNGSLCYLAGTTDNRITVHNASQLYTDNTTDEYVNELIKIIGMSDNGIITGNESQYITKTNKDGVIRIVVNKENNEKLYETLKNKLDSKIYKGLSAFASFKTNMERGKDKFCELSVLEQAKVLLQILKVFRCNAEISDIQAIGGTAHSGKKLFAKNITDVDFKLVNLSPAGLTVRIRKV

SEQ ID NO: 8461 - protein, 1505 aa, unidentified
  REGION 1..1505: note = Description of Unknown:uncultivated organism sequence
MNNEKKSSSEGKKTYFGLDLGTENIGFAVTDDEYNIAKVNGKNALGILTYSSKQIEAQSASARRAFRTTRKRLQRRKFRISLLQELFCGAMMKKDKNFFVKLNENDLQAADKTVNEGKYSLFNDKGYTDVDYYKEYPTIYHLREELSRKATTDIRKLYLAVHNIIKYRGHFLINGGLSECFDIAPVFAMLNDELDERNIDTEEMKDYKKIDMLSNFEKDKFDKIIIDANMRKKDKKIQTCLLLKAETAQQKKLVEIMYGGVINVSALFGEGAYPNKSIENFYFDEKYEQIEPQLVLELEERDYRIICQLKKIRDYITLTTILKGKESISSAMIEKFNKHKRDLKQLKELAASYEGNYYEEMFGLPLGNKDEEMSDSPLGKEDEEMSDSPRDKENKVVRNNYVAYVGGGRSKDGKKAFNNRLGKTCSRKEFYTFLNKYLDKLTEKDKTENAEIIASIKADIEDDVYMPKVISKDNSIIPHQLNALELEKILKTAADSGYYDWLKKTDDGMTVSDKIKSLLEFRVPYYAGPVKFYRKGEQRSKNSWIVRKEGRITPWTFDKLVDKNACNEEFIKRMTNSCTYLKNENALPKNSIVFKKFLALSELNKLKVNGELMSVELKREIYDKIYLKNGKPTIAKIKKLLKSKGVEVISVSGFDEELKESLNSYHIIRNIIGDKIDKFPLMAERLVFLMTIHNDSGMLETSIKKEFGDKLSKDEIKLLKGVTFSGWGRFSLKLLAGNLFDDGILLTDSTGEMRDIITILEETNLGLMEIVHSKNFNFAEVLKEYYDDAGYNDDERDVTYEDVEEMYCSPAVKRSVWQAFGLVKELVKNTKTIPDKIFIEVTRKKEPNKGKVPSRKKKIEDLYKKLKEDKNDMYLSELQELGTKLKNIDNGILNSEKIFLYFMQLGRCAYSCKPIDLGENFSNLSNYDVDHIIPRAKKKDDSLDNKVLVTSTLNKDKKDVYPVPAEYRQNADALWKTLLKAGLMTKEKYERLARKTPLTRLEEESFINRQLVETSQTALLLRDLLEKWFAYKIKQEASVGDGDKNKKADIIFVKASNVSDFRKKFSLSKSREVNDFHHAADAYLNIVVGNVLNEKYNHGIDYVSEDKESANFVKTFENNVKSYKEKRYVWVNDKNYCTICKIQKQLDTNDYAVSRKTVTAKGELYNSTIYKAEKWSNKKGAERYPMQESKLDEKGNELHPRSDTYRYGNYKSSGTAYFVIIDSLDKAGQKQRSIEAMPIFYDKKVQNGQMTILEVFEKLGLIKPEFAKIKGLPKPILKMGSLIEMDGARLRIAGMTGNEITLHNANQLYVTNEINNYVKELSIMHEKAVKTAAHIPQDELKGKTAEKKSEPKINTQDLAFRALEEEKRRRKEVNEKTKIIFITKENNLKVYEFLAKKAASHPFIGVPRYDPFRDALALGKQSFVDMDEYRQLRVILKILPAFQCNALKVDMSDLNWVEEKNGIMKTVSGKKTTCNIRINKKITDKRITLIYQNKTGLKEQRFLLT

SEQ ID NO: 8462 - protein, 1505 aa, unidentified
  REGION 1..1505: note = Description of Unknown:uncultivated organism sequence
MNNEKKSSSEGKKTYFGLDLGTENIGFAVTDDEYNIAKVNGKNALGILTYSSKQIEAQSASARRAFRTTRKRLQRRKFRISLLQELFCGAMMKKDKNFFVKLNENDLQAADKTVNEGKYSLFNDKGYTDVDYYKEYPTIYHLREELSRKATTDIRKLYLAVHNIIKYRGHFLINGGLSECFDIAPVFAMLNDELDERNIDTEEMKDYKKIDMLSNFEKDKFDKIIIDANMRKKDKKIQTCLLLKAETAQQKKLVEIMYGGVINVSALFGEGAYPNKSIENFYFDEKYEQIEPQLVLELEERDYRIICQLKKIRDYITLTTILKGKESISSAMIEKFNKHKRDLKQLKELAASYEGNYYEEMFGLPLGNKDEEMSDSPLGKEDEEMSDSPRDKENKVVRNNYVAYVGGGRSKDGKKAFNNRLGKTCSRKEFYTFLNKYLDKLTEKDKTENAEIIASIKADIEDDVYMPKVISKDNSIIPHQLNALELEKILKTAADSGYYDWLKKTDDGMTVSDKIKSLLEFRVPYYAGPVKFYRKGEQRSKNSWIVRKEGRITPWTFDKLVDKNACNEEFIKRMTNSCTYLKNENALPKNSIVFKKFLALSELNKLKVNGELMSVELKREIYDKIYLKNGKPTIAKIKKLLKSKGVEVISVSGFDEELKESLNSYHIIRNIIGDKIDKFPLMAERLVFLMTIHNDSGMLETSIKKEFGDKLSKDEIKLLKGVTFSGWGRFSLKLLAGNLFDDGILLTDSTGEMRDIITILEETNLGLMEIVHSKNFNFAEVLKEYYDDAGYNDDERDVTYEDVEEMYCSPAVKRSVWQAFGLVKELVKNTKTIPDKIFIEVTRKKEPNKGKVPSRKKKIEDLYKKLKEDKNDMYLSELQELGTKLKNIDNGILNSEKIFLYFMQLGRCAYSCKPIDLGENFSNLSNYDVDHIIPRAKKKDDSLDNKVLVTSTLNKDKKDVYPVPAEYRQNADALWKTLLKAGLMTKEKYERLARKTPLTRLEEESFINRQLVETSQTALLLRDLLEKWFAYKIKQEASVGDGDKNKKADIIFVKASNVSDFRKKFSLSKSREVNDFHHAADAYLNIVVGNVLNEKYNHGIDYVSEDKESANFVKTFENNVKSYKEKRYVWVNDKNYCTICKIQKQLDTNDYAVSRKTVTAKGELYNSTIYKAEKWSNKKGAERYPMQESKLDEKGNELHPRSDTYRYGNYKSSGTAYFVIIDSLDKAGQKQRSIEAMPIFYDKKVQNGQMTILEVFEKLGLIKPEFAKIKGLPKPILKMGSLIEMDGARLRIAGMTGNEITLHNANQLYVTNEINNYVKELSIMHEKAVKTAAHIPQDELKGKTAEKKSEPKINTQDLAFRALEEEKRRRKEVNEKTKIIFITKENNLKVYEFLAKKAASHPFIGVPRYDPFRDALALGKQSFVDMDEYRQLRVILKILPAFQCNALKVDMSDLNWVEEKNGIMKTVSGKKTTCNIRINKKITDKRITLIYQNKTGLKEHRFLLT

SEQ ID NO: 8463 - protein, 1334 aa, unidentified
  REGION 1..1334: note = Description of Unknown:uncultivated organism sequence
MKKFYIGADIGTNSVGVACTDESYRLIRAKSKDCWAVRLFDEGETAFDRRTKRTARRRLARRKQRINWLQELFEPFIDDKTFFIRLNNSQYLPEDKDSLLCGNKNNLFENEGEESKFYKKYPTIYHLRKALMDGGNFDIRLYYLALHHIIKYRGHFLYEGSIEDIRDFSNLMKGLDCAIADSYDGGLNLFDSVDSAKVRDILIDKKSGLRDKQVELEKLLCAKSKREKEILKGITGQKISPYVLFGDEFKEEKSFSLNDMSDEEFESKRSSYGESFTLLDLMHSVCNYVKFEKIFEGHSDISSAMISVYEKHKADLVLMKKVVRKQSKEDYNKIFRSVNEEKNYVNYIGYTSKDGRKIKVKKCKDEDFFKYLKKYLNGILNEDNFDIVSKIIKEIDDRIFLPKILHSDNGLFPKQVNEFELKKIIENMVRNYAETEEMASAVLSLFNYKIPYYVGPLTGCNSWVVRTDEKVKPWNFDRVVDLAKSNEAFMRRMTNKCAYIKGEDVLPKASIIYQKYDTLNQLNKLRINDRVISIELKQTIYNELFLKYPKVTDKKIKELLVREGLCSSSETKDITISGKDGDFKSSMSSYIRLKNILGDFVDDDLKSGGKVCENIILWHTLNTDKKIVEDLIEKNYGFIPEIKANIKQLKGLTFNDFGRLSAKLLIGIEGVDKTTGQILTILDVLYQTNQNLNEVLNNESYNFSEIIDEENGIETEIISYETVEELYVSPAVRRGIWQTLLMIDEYVNAVGRQPDKIFIEVTRNDGKKGDNGRTQPRKRQLQEKFKNIGSAYSDIIEELSEEKYTDLKLRQERLYLYFRQLGRCMYTGERIILDELNGNRYDVDHILPRTYVKDDSLDNKVLVCRGANATKADTYPLPTEFSRKEVRAHWKMLLDKDLISKTTYDRLTRIEPLKDDDYNDFINRQKTITDQTAKAVIELLKRKYPNAKLIFSRAKNVNDFKNRFNLFKCRETNDLHHARDAYLNVVVGNVFDTVFSTPLGQSRKDGDVWRIYNLRKLFTRDVIGAWSKDSIKIVKDTYSKPSMSVTRYATCNKGKFYDETVCRKDDSAITAPRKGKGPISDVTKYGGYTSQKTAYFAIVTSVDKKGKRIKTIEAIPVLVTYKLKSDTDAIQKYLESYLREPNIVVPKVKVKQLVSYNGSLCYLAGITNNQITVHNASQLYTDNTTDEYVNELIKIIGMGDNGIITGNESQYITKTNKDGVIRIVVNKENNEKLYETLKNKLDSKIYKGLSAFASFKKNMERGKDKFCELSVLEQAKVLLQILKVFRCNAEISDIQAIGGTAHSGKKLFAKNITDVDFKLVNLSPAGLTVRIRKV

SEQ ID NO: 8464 - protein, 1337 aa, unidentified
  REGION 1..1337: note = Description of Unknown:uncultivated organism sequence
MEKFFLGMDIGPNSVGMACTDEKYKLLRAAGRDCWAVRLFDESHTAAERRVARTARRRLERRKQRIGFLQSLFALLIEDKTFFIRLNNSQYSAEDKSAALNGDVNNLFSDDGFKDKDYHKKYPTIFHLRKALMSEPVTDLRLYYLALHHIVKYRGHFLFEGSMAEFHDASKLFEKLNAVCVDLYEERAPLFDTSKVSSAKEILLQRGKDREKRLIEFFAANDGVSKEIIKGICGYKISPQKLFVGRYKEEKSFSAEELSDEAFDALQATFGDDFALLESIRSVCNYITFERLLSGNSDISSAMIALYNKHAADLALLKKYIREHGTQEEYNRFFKFTGENSNYVNYIGYTKKGGDKKKVKICGREEFYRYTKDFLKKLSDDVNEDLERINNEIENKIFLPKILHADNGLFPYQVNEDELKKIIDNMVKNCPQTAGMAKAILPVFLYRIPYYVGPLTGKNSWAVRKEGKENEKVTPWNFKDVIDEAKSNEGFMRKMTGKCSYLYAEDVLPKFSVYYQSYNVLNQLNKLKINDCPISVELKQKIFKELFLTKKKVTDNAIKDLLVRCGKISESEKKSVTISGKDGELSVTMSSYIQLKTILGEFADEDLKNGGGVCENIILWHTLNTEKRIVEYLIMKNYGDTPVIAQNIKALKGLVFKDFGRLSKKFLCDIRAVDKETGELLTVTDILYRTNNNLNELLFSEQYNWQEVIRKENGEITDEITYEDIEKLYVSPAVRRGIWQSLKMADEYVRKIGKTPDKIFVEVTREDGVKGEAGRTISRKKQLQEKYKGIEGIADLTAELNEKTDLDLRSERLYLYFRQLGECMYSGERIEDLSTLSTDRYDVDHILPRTYIKDDGLDNKVLVLRSKNAEKTDVYPIPYGLVTAEARKHWQILLKKGLISDTTYKRLTRTEPLNDDDYGDFINRQKTITDQTAKAVIGLMAKKYPSAKMVYSKAKNVSDFKQKFNLHKCRETNDLHHARDAYLNIVVGNVYDTCFTTPMALFNKDGDKWRTFNLKTMFTRTVKGAWEQENNQSLLTVKKTYAKTSMSVTQYAYCFNGEFYDQTIYGKEDTGITAPRKLNGPLSDTSRYGGYKSQNTAYFAVVSSKGKKEKTIKTIEAVPVMVSYKAKNDPNFLQRYFESYLHQPVVLIEKLKKKQLVSYNGTLCYLAGVTGERIIVHNAVELFTDNKTDEYVNALGKLSDMEKNGRIDTQQEEYVIKTNRLKEVKLTVNRKDNIALYDYLLEKLNDKRYFGVGSFLSYYRTLLKAKEIFDTLSVLKQAATLLQILRFFKCNAETSDLSTIGGSNRSGTIRINKDITETEFSIIHRSACGLTERRQKV

SEQ ID NO: 8465 - protein, 1416 aa, unidentified
  REGION 1..1416: note = Description of Unknown:uncultivated organism sequence
MEEIYLGLDIGTNSCGYAVTDGNYNLVRIGGKDAWGVRLFEKAETAQERRAKRTARRRVVRKKLQNLWLQQLFEKEIEKIDPSFFTRLKYSNLHLEDKILSDKNLTSKYSLFNDTVKQVFTDKEYYEKYKTVYHLREKLLKNPAEDVRLLYLAIHSILTHRGHFLSETDFSSNVPIEDSFNNLLDKLSAYSVEFNDGKNVLTIKPDKISGIFLLLEDFSQGLSYRQVKENFEKNLDVKTKLDKTVASILLSGKFKTTDVFAVEKEDAVKVDFNDEKFEEVYGTLSGQLSETELAILNLFKDLYSSIQLKKLLGKNDYICEAMVERYDKHNEQLKELKTFVKTYFPSKKNLVFNAQKTSKKKKEEKSGKIANYAAYCYSYLKDGKKQIIDGVASREDFYKFIKNELLECSPEVETDLNKFEEQKQKILNSIEKNDYLLKIRSHDNIVLPNSLYKVELQQILKINEKKFKFLSEKDEKGKTISEKIIDIICFRIPYFVGPIGQSERGWIRKDKNLDFKPWTLNEIINFDEAEDKFIQNMTSKCTYLPTEDVLPKDSLLYSKFRVLNELNNLKVNGNDITVETKQRIFKGLFEKYKKISKNKLIEFLKQENIYPKNESIVITGIDNEFANTYSSYVTLANKFGEEFVNKNYDVFEKIIKYHTIISDKLRLEKRIKREFKIFSNEDVKFLKSLNYSGWGKLSGKFLNGIKFADKKSNSPEFESKTIISAMWETNKNLQEVIFCKEYNLLEKLEANIEKIQRDLVYEDVQNMYTSPSVKRGAWQAISIINELKSKLGKYPDKIFIEVTRNDQEKGDKGRKDSRFGAVVKKYKDKALKEDCLKEAINYNNLLDELNKRNNSHLRSEKLFLYFMQLGKDAYTGEPIDIAELGNDNAYNVDHIIPRSKVKDDSLDNKVLVSAAANLAKGDEYPLKRKIQFAQKDFWRMLNKNGLMSDKKLARLERTEEFTDKDADDFTNQQLVSTNQESKAVIDLLSKVYDNRRNIVFSKAMFVTEFRNRYNIFKSRDVNDLHHAKDAFLNVVVGNVLFNRFTQGYWKKDKNIKILEDKNRVDADEDKNEKVTSVVDKVFGRYVWSNQTGEVVWKGWKDVERIQKICYQNSPIISIMPYVNRNGAFYDETIYKKKNDGEKFKAAFALKEKGPMSSIEKYGGFNSVNNAYFMVVESVDSKGRIKKTIECVPIIVEYKYRNDPDKKQKIIKFIEETNNIKITRVIKDELKFRSVLKINGGLYMLTAKTSDSFKVLKLNQWYISNSDTGYIKILEKYKNMPQVAKECLKEDGERLIVSPAVKENSRPQIITRTQNVELYDLIINQLSKKIYDLSSIKAIVSNLKDKRDLFIALSIPNQTEVLLNLVKYVGGGYLADLKLLGGTEHMGTTRISKDITDLNIYLIEQSVTGLYSKGTKL

SEQ ID NO: 8466 - protein, 1334 aa, unidentified
  REGION 1..1334: note = Description of Unknown:uncultivated organism sequence
MKKFYIGADIGTNSVGVACTDESYRLIRAKSKDCWAVRLFDDGETAADRRTKRTARRRLARRKQRINWLQELFAPFIDDKTFFIRLNNSQYLPEDKDSLLCGNKNNLFENEGGESKFYKKYPTIYHLRKALMDGGNFDIRLYYLALHHIIKYRGHFLYEGSIEDIRDFSNLMKGLKCAISDSYDGELNLFDSVDSAKVRDVLIDKKSGLRDKQVELEKLLCAKSKREKEILKGITGQKISPYVLFGDEFKEEKSFSLNDMSDEEFESKRSSYGESFTLLDLMHSVCNYVKFEKIFEGHSDISSAMISVYEKHKTDLVLLKKVVRKQSKEDYNKIFRSVNEKENYVNYIGYTSKDGRKIKVKKCKDEDFFKYLKKYLNGILNEDNFDIVSKIIKEIDDRIFLPKILHSDNGLFPKQVNEFELKKIIENMVRNYPETEEMASAVLSLFNYKIPYYVGPLTGCNSWVVRTDEKVTPWNFDRVVDLAKSNEAFMRRMTNKCSYIKGEDVLPKASIIYQKYDTLNQLNKLRINDRVISVELKQTIYNELFLKYPKVTDKKIKELLVREGLCSSSETKDITISGKDGDFKSSMSSYIRLKKILGDFVDDDLKSGGKVCENIILWHTLNTDKKIVEDLIEKNYGFIPEIKANIKQLKGLTFNDFGRLSTKLLIGIEGVDKTTGQILTILDVLYQTNQNLNEVLNNESYNFSEIIDEENGIETEIVSYETVEELYVSPAVRRGIWQTLLMIDEYVNAVGRQPDKIFIEVTRNDGKKGDNGRTQPRKRQLQEKFKNIGSAYSDIIEELSEEKYTDLKLRQERLYLYFRQLGRCMYTGERIILDELNGNRYDVDHILPRTYVKDDSLDNKVLVCRGANATKADTYPLPAEFSKKEVRAHWKMLLDKDLISKTTYDRLTRIEPLKEDDYNDFINRQKTITDQTSKAVIELLKRKYPDAKLIFSRAKNVSDFKNRFNLFKCRETNDLHHARDAYLNVVVGNVFDTVFSTPLGQSRKDGDVWRIYNLKKLFTRDVIGAWSKDSIKIVKDTYSKPSMSVTRYATCNKGKFYDETVCRKDDSAITAPRKGEGPLSDVTKYGGYTSQKTAYFAIVTSVDKKGKRIKTIEAIPVLVTYKLKTDTNAIQKYLESYLREPVIVIPKVKVKQLVSYNGSLCYLAGITGNQITVHNASQLYTDNDTDEYVNELIKIIGMGDNGMITGNESQYITKTNKDGVIRIVVNKENNEKLYETLKNKLDSKIYKGLSAFASFKTNMERGKDKFCELSVLEQAKVLLQILKVFRCNAKKSNIELIGGGCDSGSIKINKNITDVDFKLVNLSPAGLTVRIRKV

SEQ ID NO: 8467 - protein, 1347 aa, unidentified
  REGION 1..1347: note = Description of Unknown:uncultivated organism sequence
MEKEQKFYLGLDIGTNSVGIACTDENYNLLRVKGKDCWAVRLFDEAQTAADRRTARTARRRLQRRRYRINQLQGLFAPFMQDNLFFLRLNNSQFFADDKAGELDGDVNNLFADSGFTDRNFHEKYPTIYHLRFALQQSPVDDIRLYYLALHHIIKYRGHFLYDGNVSEVRDVHKLFDTLNTVCENTFAENTPHFDIEKADEAKNMLLRSKGKLKDTVKSIKQLFSVQNDECGKIRIEIINGFCGAKFSPEKLLGDAYSEEKSFAFRDVNEDAFEAMQSTYGDDFALLKAMREIYNFVTFERLFNGQPNISSAMIAVYDKHKSDLKKLKGFIKKNYDTDGGKKCREMFSDVTQKANYVNYVGHVGYGKSRKRVKTCDYDSFIAYVKKFLMDGNFAHDETYDEIMAEIEAKTFLPKILHSDNGLVPHQVNEDELVKIVAQMVRAFPETAQMASKILPLFLFRIPYYVGPLVGSNSWAVCKSDEKITPWNFRDVVDEAASNEEFMRRMTNKCTYLHGVDVLPKCSIAYQKFNTLNQINKLKVNDCAISVPLKQKIFAELFLVKPRVSDKMIASLIVREGAVAPGDSVVLSGKDGGDIKASMSSYIQLKRILGDFVDYDLASGGNVCENIILWHTLNTDKRLVEDLIVKNYGDNPAVAPYVKQLKGLVFNDFGKLSGRLLTELDVVDKQTGELCTVTDLLWNTNENFNELMFDKRYNLEEVIAAENNDDDGKVDYEDVQKLYVSPAVRRGIWQSLQMVDEYVAALGKEPDKVFVEVSREEGVKGDKGRTHSRKKQLLEKYKNIDPKDVENIDELTGELNSDKISDMRLRQERLYLYFRQLGRCMYSGEPIDLDHINDSKLYDVDHILPRSYIKDDSLDNKVLVLRSKNAEKSDTYPLPLGFTNQQGWWKMLRAKDLISSGTYDRLMRTAPLTDDDYNDFINRQKVITDQTSKAVIELLKRKYPGATLVYSKAVNVADFKSKFDLYKCRETNDLHHARDAYLNVVVGNVYSTVFGVRIETYVKDGEKWKTYNLKKMFTRDVPGAWNENSIRTVKGVYNSSSMCVTRYAYCNKGAFYKQTVYSGNENITAPRKGKGPLANMERYGGYMTQSTAYFAIVESQGKKGRIKTIEAVPVMVDYQSRNDPDRVVKYFEENGLVDVKLIVPKIKIKQLVSYNGSWVWLAGITGPSIIVHNATELFTDNRTDMYVKQFVKLLEMAKNPTFDVNCEKYELTPNRERGEKITIDRESNIKLYDFFLSKFDCSKFKGFSSYVTFGKNLSIGREKFVALTVSQQVNVLNQIVNFFKCNAETADIELIGGSKISGKILFNKNITDVDFRIISQSPCGLTVHVKRV

SEQ ID NO: 8468 - protein, 545 aa, unidentified
  REGION 1..545: note = Description of Unknown:uncultivated organism sequence
MGEAYADVIAELGDEKYDDFKLRQERLYLYFRQLGKCMYTGERIDLSNLNSDLYDVDHILPRTFIKDDSLDNKVLVSRSANAKKSDTYPLPKEFFKQSEFWKILLDKRLISRTTYERLTRKDPLSEEDFNYFINRQKTVTDQTVKAVAELMKRKFPDAKIVYSKAKNVSDFKHKFDIFKCRETNDLHHARDAYLNVVVGNVYDAVFSNPLQTYRKDGDLWRDYNLKKMFTRDVKGAWNGETIATVKKVTFKSSMIVTRYALCNKGEFYDQTVYGKDNKGITAPRKGKGPLSDFKKYGGYKSEKTAYFAIVYSVGKKGEKIKTIEPVPVLTAYRARVNPGAVEEYLKTYLTAPQILVPKIKTKQLVSYNGTECYLASLDVGQIGIYNAVQSFTDNKTDEYVNALLKITDMKAKNMIVSEDESYAVKTNRSGNDKLVVNRDKNVELYRDFKNRLSKPAYKGISTFGTFQSKLEKSEGKFISLTVIDQARVLLQILKFFKCNAEVADLTLLGDGKRCGTLRINKNITNVEVKLINYSPAGLTKKVRTV

SEQ ID NO: 8469 - protein, 784 aa, unidentified
  REGION 1..784: note = Description of Unknown:uncultivated organism sequence
MEKFYLGLDIGSNSVGTACTDENYNLLRVKGKDCWSVRLFEESATAEKRRGFRTGRRRNERRKQRIGWLQALFAPFIEDKTFFIRLNNSQFFPEDKDEILGGDKNNLFGGIYDDKAFHAEFPTVYHLRERLITEGRADLRLYYLALHHIIKYRGHFLFDGGLDEVRDLGRLLEELNSVVSDLYDDAPQFDKTKADECKALLLNVSVGAKDKLNSLEKLFGTEDKVGKEILKSFAGFKISPSVLFGEEYKNEKSFSFKDMNDEAFEALRNEYADNFALLEKMRAIYGFVTFEKILAGHAGISSAMIAVYEKHKADLKRLKKFIRSERPDDYSAIFRKTDQKANYVNYIGYTSKGGVKTTVAKCKDEEFYAYLKKYLNGLTSVKDENTLKIILEEVENQTFLPKILHSDNGLFPRQVNQAELVKIVEGMVKFHPETKPVADRILPLFLFRVPYFVGPLTGKNSWVVRKNEKITPWNFDEVVDLAASNEEFMRRMTNKCSYLRGEDVLPKNSVIYQKFDVLNQLNKLKVNDCPVSVEIKKKIFDELFLVFPKVSDKRIKDLLVREGILSFAEAKDATLTGKDGEFKASMSAYVRLKKILGEFLDKDYAENGGVCENIILWHTLNTDKKIVENLILKNYGNIPVIKENIKQLKGLTFNEFGRLSQKFLTGIRAVDKRTGELVTVIEVLYETNENLNEILFDENYDFGNRIAEENGETSSEVTYSDIEDLYVSPSVRRGIWQSLVIADEYVNAIGKTPDKIFIEVTREDGKKGDEGRTVSRKKAVARKI

SEQ ID NO: 8470 - protein, 825 aa, unidentified
  REGION 1..825: note = Description of Unknown:uncultivated organism sequence
MEKEQKFYLGLDIGTNSVGIACTDENYNLLRVKGKDCWAVRLFDEAQTAADRRTARTARRRLQRRRYRINQLQGLFAPFMQDNLFFLRLNNSQFFADDKAGELDGDVNNLFADSGFTDRNFHEKYPTIYHLRFALQQSPVDDIRLYYLALHHIIKYRGHFLYDGNVSEVRDVHKLFDALNTVCENTFAENTPHFDIEKADEAKDMLLRSKGKLKDTVKNIKQLFSVQNDDCGKIRTEIINGFCGAKFSPEKLLGDAYSEEKSFAFRDVEEDAFEAMQSTYGDDFALLKAMREIYNFVTFERLFNGQPNISSAMIAVYDKHKSDLKKLKGFIKKNYDTDGGKKCREMFSDVTQKANYVNYVGHVGYGKSRKRVKTCDYDSFIAYVKKFLMDGNFAHDETYDEIMAEIEAKTFLPKILHSDNGLVPHQVNEDELVKIVAQMVRAFPETAQMASKILPLFLFRIPYYVGPLVGSNSWAVRKSDEKITPWNFRDVVDEAASNEEFMRRMTNKCTYLHGVDVLPKCSIAYQKFNTLNQINKLKVNDCAISVPLKQKIFAELFLVKPRVSDKMIASLIVREGAVAPGDSVVLSGKDGGDIKASMSSYIQLKRILGDFVDYDLASGGNVCENIILWHTLNTDKRLVEDLIVKNYGDNPAVAPYVKQLKGLVFNDFGKLSGRLLTELDVVDKQTGELCTVTDLLWNTNENFNELMFDKRYNLEEVIAAENEDDNDKVDYREVQKLYVSPAVRRGIWQSLQMVDEYVAALGKEPDKAFVEVSREEGVKGDKGRTHSRKKQLLEKYKNINPKDVENIDELTGELNSDKISDMRLR

SEQ ID NO: 8471 - protein, 519 aa, unidentified
  REGION 1..519: note = Description of Unknown:uncultivated organism sequence
MYLYFRQLGRCMYSGEPIDLDHINDSKLYDVDHILPRSYIKDDSLDNKVLVLRSKNAEKSDTYPLPLGFTNQQGWWKMLRAKDLISSGTYDRLMRTAPLTDDDYNDFINRQKVITDQTSKAVIELLKRKYPGATLVYSKAVNVADFKSKFDLYKCRETNDLHHARDAYLNVVVGNVYSTVFGVRIETYVKDGEKWKTYNLKKMFTRDVPGAWNENSIKTVKGVYNSSSMCVTRYAYCNKGAFYKQTVYSGNENITAPRKGKGPLANMERYGGYMTQSTAYFAIVESQGKKGRIKTIEAVPVMVDYQSRNDPDRVVKYFEENGLVDVKLIVPKIKIKQLVSYNGSWVWLAGITGPSIIVHNATELFTDNRTDMYVKQFVKLLEMAKNPTFDVNCEKYEFTPNRERGEKITIDRESNIKLYDFFLSKFDCSKFKGVSSYVTFGKNLSIGREKFVALTVSQQVNVLNQIVNFFKCNAETADIELIGGSKISGKILFNKNITDVDFRIISQSPCGLTVHVKRV

SEQ ID NO: 8472 - protein, 1348 aa, unidentified
  REGION 1..1348: note = Description of Unknown:uncultivated organism sequence
MKKFYIGMDIGTNSVGVACTDEDYKLLRAKGKDCWAVRLFDEAQTAEKRRTYRTNRRRLDRRKQRIKFLQELFSPFITDETFFIRLNNSQFLPEDKDALLFGDKNNLLSGEYDDKRFHEEFPTVYHLREALINGCDYDLRLYYLAIHHIVKYRGHFLFEGSLEEARDLSRLLKDLNEVISDTYGEDSPHFCVSEVEEIKKALLDENKTLKDRQVALESLFDVDDKISKEIVKGIIGAKISPVTFFGEDKREEKSFSFKDVTDETFESMKPVYGDDFALLSAIRAIYGFVTFEKILKGYSDVSSAMIAVYEKHKKDLRLLKDFIRNESCKDYIKIFKNTKEKHNYVNYIGYTSSNGKKGNTNNGKRINVEKCKNDEEFFSYLKKYLSELPDVKDEKTRDHILSELDNGRFLPKILHSDKGLFPKQINEAELVKIVRNMVKKYPETAVIAENISVLFNFRVPYYVGPLTGVNSWAVRTEEKVTPWNFDKVVDGVKSNEKFMRKMTNKCTYLRGEEVLPKASVLYQKYDTLNQLNKLRINDRPVPVELKQKIYNELFLKYAKVSDAKIKELLVREGIFSKEEIKSVSLSGKDGEFKASMSSYIRFKKIFGEEFVDKDLAGGGNVCENIILWHTLNTDKKFVVELIEKNYGQIPQIKDNIKELKGLSFSDFGRLSAKFLNGITAIDKASGEITNVTIMDVLYDTNENLNEILSDERYNFDEAIAIINGEKGEGFSYEMIDELYVSPAVRRGIRQTLLMIDEYVEAIGNAPDKIFVEVTRENGKKGNDGRTQPRKRQLQEKIKTIGEAYADVMKELGEEKCTDFELRKERLFLYFRQLGRCMYTGERIDLGELGSERYDVDHILPRKYVKDDSLDNKVLVCRSSNEAKKAYYPIPANIVNPKVREHWKLLLEKGLISKITYDRLTRTEPLNDDDFKDFINRQKVITDQTAKAVIELLKIKYPDTKLIYSKAKNVNDFRNKFDLYKCRETNDLHHARDAYLNVVVGNVYNTYCAQMQELLKKGGIEKEYDVDEIFSRNVRGAWKYGYDLKTVKNTFMKLSMTVTRHATCNKGMFYDETVFKRDDKGITAPRKNSDPLADTAKYGGYKTQKTAFFAIVSSVDKKGKRIKTIEAIPVLVSYNMKNDPDAEMKYLVDVLKLNDPVLIVPQVKVKQLVSYNGTRCYLAGITGNQIIAHNAIQLFTDNKTDEYVRELVKLLGMKGNKSVDENASEYPTKTNRLGEVKCVINRENNEKLYRMLKEKLSEKMYSGLSSAKTFGRNLETSEEKFVSLSVMEQAEVLLQILKFFKCNAEKSNLKSVEGSPNAGTILFNKDITDVNFKLIDLSPAGLTERVRKV

SEQ ID NO: 8473 - protein, 526 aa, unidentified
  REGION 1..526: note = Description of Unknown:uncultivated organism sequence
MRLRQERLYLYFRQLGRCMYSGEPIDLDHINDSKLYDVDHILPRSYIKDDSLDNKVLVLRSKNAEKSDTYPLPLGFTNQQGWWKMLRAKDLISSGTYDRLMRTAPLTDDDYNDFINRQKVITDQTSKSVIELLKRKYPNATLVYSKAVNVADFKSKFDLYKCRETNDLHHARDAYLNVVVGNVYSTVFGVRIETYVKDGEKWKTYNLKKMFTRDVPGAWNENSIRTVKGVYNSSSMCVTRYAYCNKGAFYKQTVYSGNENITAPRKGKGPLANMERYGGYMTQSTAYFAIVESQGKKGRIKTIEAVPVMVDYQSRNDPDRVVKYFEENGLVDVKLIVPKIKIKQLVSYNGSRVYLAGVGDVRILVHNATELFVDNKIDDYVNQLLKIVEMAKQPTFNKNSDCYIVKTNRMGDIKLVVDKGSNVKLYDELILKLECKQFQGFGAYTSFRNVLTESREKFVDLSTLEQAIVLLEVLKFFKNNADTADLSLIGESKRAGILRFSKNITDVDFRIISQSPCGLTVHVKRV

SEQ ID NO: 8474 - protein, 770 aa, unidentified
  REGION 1..770: note = Description of Unknown:uncultivated organism sequence
MEKEQKFYLGLDIGTNSVGIACTDENYNLLRVKGKDCWAVRLFDEAQTAADRRTARTARRRLQRRRYRINQLQGLFAPLMQDNLFFLRLNNSQFFADDKAGELDGDVNNLFADSGFTDRNFHEKYPTIYHLRFALQQSPVDDIRLYYLALHHIIKYRGHFLYDGNISEVRDVHKLFDALNTVCENTFAENTPHFDIEKADEAKDMLLRSKGKLKDTVKSIKQLFSVQNDDCGKIRTEIINGFCGAKFSPEKLLGDAYSEEKSFAFRDIEEDAFEAMQSTYGDDFALLKAMREIYNFVTFERLFNGQPNISSAMIAVYDKHKSDLKKLKGFIKKNYDTDGGKKCREMFSDVTQKANYVNYVGHVGYGKSRKRVKTCDYDSFIAYVKKFLMDGNFAHDETYDEIMAEIEAKTFLPKILHSDNGLVPHQVNEDELVKIVAQMVRAFPETAQMASKILPLFLFRIPYYVGPLVGSNSWAVRKSDEKITPWNFRDVVDEAASNEEFMRRMTNKCTYLHGVDVLPKCSIAYQKFNTLNQINKLKVNDCAISVPLKQKIFAELFLVKPRVSDKMIASLIVREGAVAPGDSVVLSGKDGGDIKASMSSYIQLKRILGDFVDYDLASGGNVCENIILWHTLNTDKRLVEDLIVKNYGDNPAVAPYVKQLKGLVFNDFGKLSGRLLTELGVVDKQTGELCTVTDLLWNTNENFNELMFDKRYNLEEVIAAENNDDDGKVDYEDVQKLYVSPAVRRGIWQSLQMVDEYVAALGKEPDKVFV

SEQ ID NO: 8475 - protein, 1010 aa, unidentified
  REGION 1..1010: note = Description of Unknown:uncultivated organism sequence
MKSELFECDVENNVELDKYEERKQNILNAIEKNDFLLKLRSNDNILLPNSLYQAELKQILKVSAQKFNFLNNKDADGRSVGQKIIDVVSFRVPYFVGPIGESENGWIRKDKSADFKPWTLDKIIDLDEAENRFIQNMTNKCTYLPTEDVLPQKSLLYSKFRVLNELNNLKINGNAITVETKQQIFDGLFKKTPKVSTKKLVEFLKQNNIINKNDSNVVFTGIDKEFANDYSSYVTFATKFGEEFVNKNLEVFEKIIKYHTIISDKSRLAKRIKREFNIFSDEDIKFLKSLNFSGWGSLSQKFLEGLKFSDKKSANPEMEALTVMSALWETNKNLQEIIFCKTYDLQQKLDANIQKIQRDLLYDDIQNMYTSPAVKRGTWQAISIINELKNKLGKYPDKIFVEVTRNNQEKGEAGRKDSRHKMVVKKYKDKQLKLDCQKLCIEFNKLMEELNQKDNSNLRSEKLYLYFMQLGKDIYTGKPIDISQLNNDNMYNVDHIIPRCKVKDDSIDNKVLVSAAANLAKSDNYPVDGHIQASQKAFWELLQENGLMTDSKLARLQRTEEFTEKDADNFTNQQLVSTNQESKAVIDLLSKVYSNKRNIIFSKAMFVSDFRKNFNINKSRDVNALHHAQDAYLNVVVGNVLFNRFTEGYWKKDTQENNNQTEDKNANTTSVVEKLFRRTVWSNQTGEVVWKGQQSIDLVRKNCEKNSPCISIMPYENKNGEFYNATVYKSSKNHSATSASFALKAKGPLSSIDKYGGYNSLKNAYFIAVESVDANGTVNKTIETVPIIVEYQHRNDANKTQKIIEYIEKTNNIKITKVIKDKIKYRSLLKIDGGLYMLTAKTEDSLKLLKVNQWFLSNKDIGYIKILEKHQNMPATIKELLKTTDEEIIVSPAVKTNSKQLAISRTNNLYLYDLIIAQLGKKIYSLSSISGLVEKLTNARSVFLSLSISAQVELLLGLVKYVGGAYTVDLTLLGEKKQAGSTRIGKNISNLNISLIEQSVTGLYAKEIVL

SEQ ID NO: 8476 - protein, 1334 aa, unidentified
  REGION 1..1334: note = Description of Unknown:uncultivated organism sequence
MKKFYIGADIGTNSVGVACTDESYRLIRAKSKDCWAVRLFDEGETAFDRRTKRTARRRLARRKQRINWLQELFEPFIDDKTFFIRLNNSQYLPEDKDSLLCGNKNNLFENEGEESKFYKKYPTIYHLRKALMDGGNFDIRLYYLALHHIIKYRGHFLYEGSIEDIRDFSNLMKGLDCAIADSYDGGLNLFDSVDSAKVRDILIDKKSGLRDKQVELEKLLCVKSKREKEILKGITGQKISPYVLFGDEFKEEKSFSLNDMSDEEFESKRSSYGESFTLLDLMHSVCNYVKFEKIFEGHSDISSAMISVYEKHKADLVLLKKVVRKQSKEDYNKIFRSVNEEKNYVNYIGYTSKDGRKIKVKKCKGEDFFKYLKKYLNGILNEDNFDIVSKIIKEIDDRIFLPKILHSDNGLFPKQVNEFELKKIIENMVRNYAETEEMASAVLSLFNYKIPYYVGPLTGCNSWVVRTDEKVTPWNFDRVVDLAKSNEAFMRRMTNKCAYIKGEDVLPKASIIYQKYDTLNQLNKLRINDRVISIELKQTIYNELFLKYPKVTDKKIKELLVREGLCSSSETKDITISGKDGDFKSSMSSYIRLKNILGDFVDDDLKSGGKVCENIILWHTLNTDKKIVEDLIEKNYGFIPEIKANIKQLKGLTFNDFGRLSAKLLIGIEGVDKTTGQILTILDVLYQTNQNLNEVLNNESYNFSEIIDEENGIETEIISYETVEELYVSPAVRRGIWQTLLMIDEYVNAVGRQPDKIFIEVTRNDGKKGDNGRTQPRKRQLQEKFKNIGSAYSDIIEELSEEKYTDLKLRQERLYLYFRQLGRCMYTGERIILDELNGNRYDVDHILPRTYVKDDSLDNKVLVCRGANATKADTYPLPTEFSRKEVRAHWKMLLDKDLISKTTYDRLTRIEPLKDDDYNDFINRQKTITDQTAKAVIELLKRKYPNAKLIFSRAKNVNDFKNRFNLFKCRETNDLHHARDAYLNVVVGNVFDSVFSTPLGQSRKDGDVWRIYNLKKLFTRDVIGAWSKDSIKIVKDTYSKPSMSVTRYATCNKGKFYDETVCRKNDSAITAPRKGKGPLSDFTKYGGYTTQKTAYFAIVTSVDKKGKSIKTIEAIPVLVTYKLKSDTDAIQKYLESYLREPNIVVPKVKVKQLVSYNGSLCYLAGTTDNRITVHNASQLYTDNTTDEYVNELIKIIGMGDNGIITGNESQYITKTNKDGVIRIVVNKENNEKLYETLKNKLDSKIYKGLSAFASFKTNMERGKDKFCKLSVLEQAKVLLQILKVFRCNAVNSNIELIGGGRGSGSIKINKNITDVDFKLVNLSPAGLTVRIRKV

SEQ ID NO: 8477 - protein, 1416 aa, unidentified
  REGION 1..1416: note = Description of Unknown:uncultivated organism sequence
MEKIYLGLDIGTNSCGYAVTDGNYNLVRIGGKDAWGVRLFEEAETAQERRAKRTARRRIVRKKLQNLWLQQLFEKEIEKVDPSFFTRLKYSNLNLEDKILSDKNLTSKYSLFNDTVKRVFTDKEYYAKYETVYRLRKELLSSPAEDVRLLYLAIHSILTHRGHFLSETDFSSNVPIEDSYNCLLDKLSAYSVEFNDSKNGLTIKPDKISGIFLLLEDFAQGLPFRQVKENFEKNLDVKTKLDKTVASILLSGKFKTTDVFAVEKEDAVKVDFNDEKFEEVYGTLSGQLSETELAILNLLKDIYSNIQLKKLLGKNNYICEAMVERYDKHNEQLKELKSFVKTYFPSKKNLVFNAQKTSKKKKEEKSGKIANYAAYCYSDLKDGKKQIIDGVASREDFYKFIKNELLECSPEVETDLIKFEEQKQKILNSIEKNDYLLKIRSHDNIVLPNSLYKVELQQILKINEKKFKFLSEKDEKGKTISEKIVDIICFKIPYFVGPIGQSERGWIRKDKNLDFKPWTLNEIINFDEAEDKFIQNMTSKCTYLPTEDVLPKDSLLYSKFRVLNELNNLKVNGNDITVETKQRIFKGLFEKYKKISKNKLIEFLKQENIYPKNESIVITGIDNEFANNYSSYVTLANKFGEEFVNKNYDVFEKIIKYHTIISDKLRLEKRIKREFKIFSNEDVKFLKSLNYSGWGKLSGKFLNGIKFADKKSNSPEFESKTIISAMWETNKNLQEVIFCKEYNLLEKLEANIEKIQRDLVYEDVQNMYTSPSVKRGTWQAISIINELKSKLGKYPDKIFIEVTRNDQEKGDKGRKDSRFGAVVKKYKDKTLKEDCLKEAINYNNLLDELNKRNNSHLRSEKLFLYFMQLGKDAYTGEPIDIAELGNDNAYNVDHIIPRSKVKDDSLDNKVLVSAAANLAKGDEYPLKRKIQFAQKDFWRMLNKNGLMSDKKLARLERTEEFTDKDADDFTNQQLVSTNQESKAVIDLLSKVYDNRRNIVFSKAMFVTEFRNRYNIFKSRDVNDLHHAKDAFLNVVVGNVLFNRFTQGYWKKDKNIKILEDENRVDADEDKNEKVTSVVDKVFGRYVWSNQTGEVVWKGWKDVERIQKICYQNSPVISIMPYVNRNGAFYDETIYKKKNDGEKFKAAFALKEKGPMSSIEKYGGFNSVNNAYFMVVESVDNKGRIKKTIECVPIIVEYKYRNDPDKKQKIIKFIEETNNIKITRVIKDELKFRSVLKINGGLYMLTAKTSDSFKVLKLNQWYISNSDTGYIKILEKYKNMPQVAKECLKEDGERLIVSPAVKENSRPQIITRTQNVELYDLIINQLSKKIYDLSSIKAIVSNLKDKRDLFIALSIPNQTEVLLNLVKYVGGGYLADLKLLGGTEHMGTTRISKDITDLNIYLIEQSVTGLYSKGTKL

SEQ ID NO: 8478 - protein, 748 aa, unidentified
  REGION 1..748: note = Description of Unknown:uncultivated organism sequence
MSSYIRLKNILGDFVDDDLKSGGKVCENIILWHTLNTDKKIVEDLIEKNYGFIPEIKANIKQLKGLTFNDFGRLSAKLLIGIEGVDKTTGQILTILDVLYQTNQNLNEVLNNESYNFSEIIDEENGIETEIISYETVEELYVSPAVRRGIWQTLLMIDEYVNAVGRQPDKIFIEVTRNDGKKGDNGRTQPRKRQLQEKFKNIGSAYSDIIEELSEEKYTDLKLRQERLYLYFRQLGRCMYTGERIILDELNGNRYDVDHILPRTYVKDDSLDNKVLVCRGANATKADTYPLPTEFSRKEVRAHWKMLLDKDLISKTTYDRLTRIEPLKDDDYNDFINRQKTITDQTAKAVIELLKRKYPNAKLIFSRAKNVNDFKNRFNLFKCRETNDLHHARDAYLNVVVGNVFDSVFSTPLGQSRKDGDVWRIYNLKKLFTRDVIGAWSKDSIKIVKDTYSKPSMSVTRYATCNKGKFYDETVCRKDDSAITAPRKGKGPISDVTKYGGYTSQKTAYFAIVTSVDKKGKRIKTIEAIPVLVTYKLKTDTNAIQKYLESYLREPIIVIPKVKVKQLVSYNGSLCYLAGITNNQITVHNASQLYTDNTTDEYVNELIKIIGMGDNGIITGNESQYITKTNKDGVVRIVVNKENNEKLYETLKNKLDSKIYKGLSAFASFKTNMERGKDKFCELSVLEQAKVLLQILKVFRCNAEISDIQAIGGTAHSGKKLFAKNITDVDFKLVNLSPAGLTVRIRKV

SEQ ID NO: 8479 - protein, 532 aa, unidentified
  REGION 1..532: note = Description of Unknown:uncultivated organism sequence
MKKFYIGADIGTNSVGVACTDESYRLIRAKSKDCWAVRLFDEGETAFDRRTKRTARRRLARRKQRINWLQELFEPFIDDKTFFIRLNNSQYLPEDKDSLLCGNKNNLFENEGEESKFYKKYPTIYHLRKALMDGGNFDIRLYYLALHHIIKYRGHFLYEGSIEDIRDFSNLMKGLDCAIADSYDGGLNLFDSVDSAKVRDILIDKKSGLRDKQVELEKLLCAKSKREKEILKGITGQKISPYVLFGDEFKEEKSFSLNDMSDEEFESKRSSYGESFTLLDLMHSVCNYVKFEKIFEGHSDISSAMISVYEKHKADLVLMKKVVRKQSKEDYNKIFRSVNEEKNYVNYIGYTSKDGRKIKVKKCKDEDFFKYLKKYLNGILNEDNFDIVSKIIKEIDDRIFLPKILHSDNGLFPKQVNEFELKKIIENMVRNYAETEEMASAVLSLFNYKIPYYVGPLTGCNSWVVRTDEKVTPWNFDRVVDLAKSNEAFMRRMTNKCAYIKGEDVLPKASIIYQKYDTLNQLNKLRINDRVI

SEQ ID NO: 8480 - protein, 1355 aa, unidentified
  REGION 1..1355: note = Description of Unknown:uncultivated organism sequence
MKKFYLGMDIGTDSVGIAGTDENYNLLCARGKDLWAVRLFDEAKDASARRMKRTARRRLQRRKQRIEWLQELFAPYIEDKCFFLRLNNSGFEKEDKHESLQSQYSLFADAGYTDREFYKKYPTIFHLRRALAERASEEKTDLRLYYLALHHIVKYRGHFLFEGDSISDIRDIKKLFEEFNAVAEDIFPEGDIRLPLEKAEAFRALALSAKGIRDKKKTGEELFETNSPALAELVGLLLGAKAKIGVIFGEEYGEYKEEKLSFKEILDEDFEAKQELYGDNYPLLEAARSIYNYFVFEKILDGNHCISAAMVAVYERHRRDLRLLKNFVKTQFSKEIYYKIFRSEKEAANYCNYISYTKTEKKKIFVKKCKYGDFCKFLKKTLTENRDCVKDKKTLDDILFKIENGDFLPKILNADNGLFPHQINGAELDKILANLCKEYPCFAEKEADGFSVAEKIRKIFLFKIPYYVGPLNNYHEENGNSWVVRKSGKITPWNFEDMVDTASSNEKFIRRMTNKCSYLYGKDVLPKCSMYYQAFDVLNQLNKIKFNEQPISVEMKQELFHSLFLRHRKVTKKLIKEYLTATGKYTSAEAKELSVSGFDGELKANMGAYITLKNCLGDYVDEHPETCENIILWHTLNTDKTIVERQILSHYGDVPVIKEKIKALKGITSFKEFGRLSKELLCELIGGEDPVTREVYTILNRLYHTNFNFNELLFSDTYRFNSAIEAMNAGKDGDVGYDDVKELYVSPMVRRGIWQALTMADEYVQAVGRVPDKIFIEVTRQGDEKKKPTVSRKNQLLENYKGLGQDCRNIDELLTELNDKTDSQLRQERLYLYFKQLGRCAYTGQLIRLEELNGDLYDVDHIMPRSITKDDSLENKVLVRREKNAQKSDEYPLPAGFTDQQRFWKLLRDKGLMSEKKYALLTRTKPLTEDDFRDFINRQLVVTNQTVKAVAELLKRKYGEKGTRIVYSKAKNVDGFKNQYDIVKCRETNDLHHARDAYLNIVVGNVYDTKFTSAYDYYYRKGDAWREYNLKTLFERPVKDAWIGREGIAFVKDVLRKPSMLITRYAYINKGEFYNETIYGKDDKGISAPRKSIEPYNKTEKYGGYKSLTTAYFSVVESKDKKGKLIKTVEAIPVLADYQSKGDREAVLAYLSRMGLREPKLLLPKIKIKSLVSVNGFKVWLAGVTGNRLIIHNAQQWFTDEKTDLYIKNLGKLVEWERTGKIAEEEKARETFSMIKNRKEEVSLLIDRSQNVALYREIVAKLQTKLYRGLSAARSFAEKLSAKEEIFVSLSVLEQAKVLLQIARFMKCNAEAADLSLLKDGAACGILLIGKNITDVDFAVIHQSPCGINTYIQRV

SEQ ID NO: 8481 - protein, 1334 aa, unidentified
  REGION 1..1334: note = Description of Unknown:uncultivated organism sequence
MKKFYIGADIGTNSVGVACTDESYRLIRAKSKDCWAVRLFDEGETAFDRRTKRTARRRLARRKQRINWLQELFEPFIDDKTFFIRLNNSQYLPEDKDSLLCGNKNNLFENEGEESKFYKKYPTIYHLRKALMDGGNFDIRLYYLALHHIIKYRGHFLYEGSIEDIRDFSNLMKGLDCAIADSYDGGLNLFDSVDSAKVRDILIDKKSGLRDKQVELEKLLCVKSKREKEILKGITGQKISPYVLFGDEFKEEKSFSLNDMSDEEFESKRSSYGESFTLLDLMHSVCNYVKFEKIFEGHSDISSAMISVYEKHKADLVLLKKVVRKQSKEDYNKIFRSVNEEKNYVNYIGYTSKDGRKIKVKKCKGEDFFKYLKKYLNGILNEDNFDIVSKIIKEIDDRIFLPKILHSDNGLFPKQVNEFELKKIIENMVRNYAETEEMASAVLSLFNYKIPYYVGPLTGCNSWVVRTDEKVTPWNFDRVVDLAKSNEAFMRRMTNKCAYIKGEDVLPKASIIYQKYDTLNQLNKLRINDRVISIELKQTIYNELFLKYPKVTDKKIKELLVREGLCSSSETKDITISGKDGDFKSSMSSYIRLKNILGDFVDDDLKSGGKVCENIILWHTLNTDKKIVEDLIEKNYGFIPEIKANIKQLKGLTFNDFGRLSAKLLIGIEGVDKTTGQILTILDVLYQTNQNLNEVLNNESYNFSEIIDEENGIETEIISYETVEELYVSPAVRRGIWQTLLMIDEYVNAVGRQPDKIFIEVTRNDGKKGDNGRTQPRKRQLQEKFKNIGSAYSDIIEELSEEKYTDLKLRQERLYLYFRQLGRCMYTGERIILDELNGNRYDVDHILPRTYVKDDSLDNKVLVCRGANATKADTYPLPTEFSRKEVRAHWKMLLDKDLISKTTYDRLTRIEPLKDDDYNDFINRQKTITDQTAKAVIELLKRKYPNAKLIFSRAKNVNDFKNRFNLFKCRETNDLHHARDAYLNVVVGNVFDSVFSTPLGQSRKDGDVWRIYNLKKLFTRDVIGVWSKDSIKIVKDTYSKPSMSVSRYATCNKGKFYDETVCRKNDSAITAPRKGKGPLSDVTKYGGYTTQKTAYFAIVTSVDKKGKSIKTIEAIPVLVTYKLKTDTNAIQKYLESYLREPNIVVPKVKVKQLVSYNGSLCYLAGITNNQITVHNASQLYTDNTTDEYVNELIKIIGMGDNGIITGNESQYITKTNKDGVIRIVVNKENNEKLYETLKNKLDSKIYKGLSAFASFKKNMERGKDKFCELSVLEQAKVLLQILKVFRCNAEISDIQAIGGTAHSGKKLFAKNITDVDFKLVNLSPAGLTVRIRKV

SEQ ID NO: 8482 - protein, 1355 aa, unidentified
  REGION 1..1355: note = Description of Unknown:uncultivated organism sequence
MKKFYLGMDIGTESVGMAATDENYNLLRARGKDLWAVRLFDAANDASARRMKRTARRRLMRRKQRVEWLQELFVPYLEDEYFFLRLNNSGFEKEDKHENLQSQYSLFADGEFTDREFYKNYPTVFHLRQALAEEKSAEKTDLRLYYLALHHIVKYRGHFLFEGESINELRDIKKLFEAFNAVAEEIFPEGEMRLPLEKAEAFRLLALSDKGIRDKKREGEELFHTKSAAMAELIGLLLGAKVKTGIIFAESYEEYKEEKVSFKEISDEDFEAKQEVYGDNFALLKAARAIYNYFVFEKILDGNHSISAAMVAVYERHRRDLRLLKNFVKTQLPKDVYYKIFRSVKESANYANYVCYTKTGKKKIPAKKCKYEDFCKFLKKVLTENKACAEDQETLNYILSKIENGEFLPKILNADNGLFPHQINGAELDVILANLCKEYPSFAEKDPDGFSPAEKIRKIFLFRIPYYVGPLNTYHKKNGNSWAVRKAGKITPWYFENVVDMAASNEKFIRRMTNKCSYLYGKDVLPKYSMYYQAFDVLNQLNKIKFNQQPISVELKQELFQSLFLRHRKVTKKLIKEYLITTGKYTPAEAKELSVSGFDGELKANMGSYIVLKNCLGEYVDEHPEVCENIILWHTLNTDKNIVESLILSRYGNVPVIKEKIKALKGITSFKEFGRLSKELLCELAGGEDPVTGEVYTILNRLYHTNLNFNELLFSDAYRFNTAIEETNAGRGGDVVYNDVKELYVSPMVRRGIWQALSMADEYVQAVGRVPDKIFIEVTRQEDEKKKPTVSRKNRLLEEYKGLGEDCRNIDELLTELNDKTDSQLRQERLYLYFKQLGRCAYTGQLIRLDELNSDLYDVDHIMPQSVTKDDSLENKVLVKREKNAQKSDQYPLPVGFTDQQGFWKLLKDKGLMGEKKYALLTRTQPLTEEDFRDFINRQLVVTNQTVKAVAELLKRKYGGQGTRIVYSKAKNVDDFKQKYGLVKCRETNDLHHARDAYLNVVVGNVYDTKFTSAYDYYYRKNDAWREYNLKTLFERPTKDAWIGQEGIAFIKSVLRKPSMQVTRYAYTNKGEFYNETVYGKEDGGISAPRKAVKPYDKTGKYGGFKSLTTAYFTAVESQDKKGMLMKTIEAIPVLVDYQSKDDEKKVLAYLSQIGLREPRLLIPKIKIKSLVSVNGFKVWVAGVTGNRLIIHNAQQWFTDEKTDLYIKNLGKLVEWERTGKIAEEERMKEIFPMVKNRKEEVSVLIDRTQNVALYREIVTKLHSKLYQGLSAARSFAEKLSAKEESFLSLSVLEQAKVLLQIVRFMKCNAEAADLSLLKDGSRCGILSIGKNITDVDFKVIHQSPCGLSTYIQRT

SEQ ID NO: 8483 - protein, 1347 aa, unidentified
  REGION 1..1347: note = Description of Unknown:uncultivated organism sequence
MEKEQKFYLGLDIGTNSVGIACTDENYNLLRVKGKDCWAVRLLDEAQTAADRRTARTARRRLQRRRYRINQLQGLFAPFMQDNLFFLRLNNSQFFADDKAGELDGDVNNLFADSGFTDRNFHEKYPTIYHLRFALQQSPAGDIRLYYLALHHIIKYRGHFLYDGNVSEVRDVHKLFDALNTVCENTFAENTPHFDTEKADEAKDMLLRSKGKLKDTVKSIKQLFSVQNDECGKIRTEIINGFCGAKFSPEKLLGDAYSEEKSFAFRDVEEDAFEAMQSTYGDDFALLKAIREIYNFVTFERLFNGQPNISSAMIAVYDKHKRDLKKLKGFIKKNYDTDGGKKCREMFSDVTQKANYVNYVGHVGYGKSRKRVKTCDYDSFIAYVKKFLMDGNFAHDETYDEIMAEIEAKTFLPKNLHSDNGLVPHQVNEDELVKIVAQMVRAFPETAQMASKILPLFLFRIPYYVGPLVGSNSWAVRKSDEKITPWNFRDVVDEAASNEEFMRRMTNKCTYLHGVDVLPKCSIAYQKFNTLNQINKLKVNDCAISVSLKQKIFAELFLVKPRVSDKMIASLIVREGAVAPGDSVVLSGKDGGDIKASMSSYIQLKRILGDFVDYDLASGGNVCENIILWHTLNTDKRLVEDLIVKNYGDNPAVAPYVKQLKGLVFNDFGKLSGRLLTELGVVDKQTGELCTVTDLLWNTNENFNELMFDKRYNLEEVIAAENEDDNDKVDYREVQKLYVSPAVRRGIWQSLQMVDEYVAALGKEPDKVFVEVSREEGVKGDKGRTHSRKKQLLEKYKNINPKDVENIDELTGELNSDKISDMRLRQERLYLYFRQLGRCMYSGEPIDLDHINDSKLYDVDHILPRSYIKDDSLDNKVLVLRSKNAEKSDTYPLPLGFTNQQGWWKMLRAKDLISSGTYDRLMRTAPLTDDDYNDFINRQKVITDQTSKAVIELLKRKYPNATLVYSKAVNVADFKSKFDLYKCRETNDLHHARDAYLNVVVGNVYSTVFGVRIETYVKDGEKWKTYNLKKMFTRDVPGAWNENSIRTVKGVYNSSSMCVTRYAYCNKGAFYKQTVYSGNENITAPRKGKGPLANMERYGGYMTQSTAYFAIVESQGKKGRIKTIEAVPVMVDYQSRNDPDRVVRYFEENGLVDVKLIVPKIKIKQLVSYNGSRVYLAGVGDVRILVHNATELFVDNKIDDYVNQLLKIVEMAKQPTFNKNSDCYIVKTNRMGDIKLVVDKGSNVKLYDELILKLECKQFQGFGAYTSFRNVLTESREKFVDLSTLEQAIVLLEVLKFFKNNADTADLSLIGESKRAGILRFSKNITDVDFRIISQSPCGLTVHVKRV

SEQ ID NO: 8484 - protein, 1336 aa, unidentified
  REGION 1..1336: note = Description of Unknown:uncultivated organism sequence
MNKKDFYVGLDIGTNSVGIACTDQDYNLRRSNGKDCWAVRLFDTANTAAERRVFRTARRRLQRRKYRLGQLQALFAPYIADDKFFIRLNNSQFFVDDKDECLSADKNTLFADSGYTDKEFHEAFPTIYHLRLALQNGHASDIRLYYLALHHIVKYRGHFLFEGSVGDIRDIKKLFVDLNTACEAVYADEVPYFDTQLCEQAKNTLMKPSGIRDKQKALEALFDGTSKAQSEIIKAMCGGKLAPKTMFEGRYEEEKSFSLSEMQDEAFDALAEVFGDDFVLLQALRNLCNFVKFEKLFAGQPNISSAMIAVYDKHAADLAMLKIFLKTYAPQMYNKVFRSVTESANYVNYIGYNKKKSAKTKVAPCKYEDFLAFVKKIVAAVDCADTELRDKILAEIDNKTFLPKILHADNGLIPHQVNEDELVKIVKSMTEAFPETQAMAKQILPLFRFRIPYYVGPLVGENSWAVRKSDERITPWNFNEVIDLAASNEQFMRRMTNKCTYLHGEDVLPKCSIVYQKFNTLNQINKLQVDGRAISVELKKKIFDQLFLAKSKVSDKMIVDLLVREGVVSPQERTQAVLSGKDGDVKASMSSYIQLKRILGDFVDEDISSGGNVCENIILWHTLNTDKSIVEDLLRRNYGDNPHITPYIKQLKGLMFADFGRLSDKLLTGLRTVDKSTGELRSILDLLYDTNQNFNEIIFDERYDFAELIRKENSGESTEITYEEDIATMRVSPALKRGIWQSLQLVYEYVAALGGSPDKIFVEVTREDGVKGNDGRTVSRKKQLLEKYKGVEGIDELVAELQSDDVSDMRLRQEKLYLYFRQLGRCMYTGKRIDLSQLNTDLYDVDHILPRTYIKDDSLDNKVLVLRSKNAEKSDAYPLPQGFSNQAPFWKLLLDKGLIGEKTYKRLTRTAPLTDDDYNDFINRQKTITDQTAKAVVELLKRKYPQAKVVFSKAKNVSDFKQKFDLHKCRETNDLHHARDAYLNIVVGNVYDACFTTPMAQFRKDGDVWRTYNLKTMFTRNVKGTWDENSLATVKKTYSKCSMSVTEYTYCGKGAFYNQTVYGAGDTSVTAPRKANGPLANTARYGGYKSQNTAYFAIVDSLGKKDVTQRTMEAIPVMVAYRATTDTNAVYDYLTNTLQLRDVKVVVPKVKKNQLVSYNGSLVRLTGVTGVYITTNNDRQLFTDNKTDEYVNQLLKLLEMDKNGRVDKTASEYVMKTNRMGDVKLVVDKAHNENLYNCFVEKLQGGKYGKLSSFVTFGKNLQSGKEKFANLTTLEQAYVIVQILRFFKCDAQTADIRLIGGSGLSGKVLFNKDITTVDFQLIDQSPCGLTVRTRKL

SEQ ID NO: 8485 - protein, 571 aa, unidentified
  REGION 1..571: note = Description of Unknown:uncultivated organism sequence
MEKFYIGTDIGTNSAGVACTDENYNLLRVKGKDCWAVRLFDEGKTAVDRRTFRTGRRRLQRRKQRIAWLQDLFAPYMEDETFFIRLNNSQFLPEDKDALLGGDKNTLFAGVYDDKKFHAEFPTVYHLREALMRGGVNDLRLYYLALHHIVKYRGHFLTEGSVDDVRDFGRLLGNLNGVISDVYGDEVPLFSEAAVDEAKNVLLDKTLGIKDRSTELEKIFGVKDKTSKEIIKGLCGGKISPAVLFGDEYKEEKSFSFKEITDDNFESMRGTYGDNFTVLEVIRSIYGYVIIENLLSGHDDLSSAMIAVYDKHKKDLLALKAFIRSERPEDYNKIFKSTDEKSNYVNYIGYTKKGGDKKKVKKCKDDEFYAYIKKYLQGLTDVKDIAARDKFLKDIEAGSFMQKILHSDNGLFPKQINEYELKKILENMVKSFPATAEIKDKIVTLFNYRIPYYVGPLAGKEETCWAVKKSNEKITPWNFDDVIDKAKSNEKFMLRMTNKCSYLRGEDVLPKASIIYQKFDTLNQLNKLRVNDELLSIDLKQKIFNELFLKYPKVSDKKIIDLLVRETRPRA

SEQ ID NO: 8486 - protein, 847 aa, unidentified
  REGION 1..847: note = Description of Unknown:uncultivated organism sequence
DNLFFLRLNNSQFFADDKAGELDGDVNNLFADSGFTDRNFHKKYPTIYHLRFALQQSPVDDIRLYYLALHHIIKYRGHFLYDGNVSEVRDVHKLFDALNTVCENTFAENTPHFDIEKADEAKDMLLRSKGKLKDTIKSIKQLFSVQNDDCGKIRTEIINGFCGAKFSPEKLLGDAYSEEKSFAFRDVEEDAFEAMQSTYGDDFALLKAMREIYNFVTFERLFNGQPNISSAMIAVYDKHKSDLKKLKGFIKKNYDTDGGKKCREMFSDVTQKANYVNYVGHVGYGKSRKRVKTCDYDSFIAYVKKFLMDGNFAHDETYDEIMAEIEAKTFLPKILHSDNGLVPHQVNEDELVKIVAQMVRAFPETAQMASKILPLFLFRIPYYVGPLVGSNSWAVRKSDEKITPWNFRDVVDEAASNEEFMRRMTNKCTYLHGVDVLPKCSIAYQKFNTLNQINKLKVNDCAISVSLKQKIFAELFLVKPRVSDKMIASLIVREGAVAPGDSVVLSGKDGGDIKASMSSYIQLKRILGDFVDYDLASGGNVCENIILWHTLNTDKRLVEDLIVKNYGDNPAVAPYVKQLKGLVFNDFGKLSGRLLTELDVVDKQTGELCTVTDLLWNTNENFNELMFDKRYNLEEVIAAENEDDNDKVDYREVQKLYVSPAVRRGIWQSLQMVDEYVAALGKEPDKVFVEVSREEGVKGDKGRTHSRKKQLLEKYKNINPKDVENIDELTGELNSDKISDMRLRQERLYLYFRQLGRCMYSGEPIDLDHINDSKLYDVDHILPRSYIKDDSLDNKVLVLRSKNAEKSDTYPLPLGFTNQQGWWKMLRAKDLISSGTYDRLMRTQPLR

SEQ ID NO: 8487 - protein, 1336 aa, unidentified
  REGION 1..1336: note = Description of Unknown:uncultivated organism sequence
MEKFYIGADIGTNSVGIACTDENYNLLRIKGKDCWTVRLFDECKTAEERRGFRTSRRRTARRKQRINFLQSLFAPYMNDKTFFIRLNNSQFLPEDKSELLHGDKNTLFSGDYDDKKFHAEFPTIYHLRDKLMSGGIYDLRLYYLALHHIIKYRGHFLFEGSMEDVRDLGKLLNALNDAMVGVYGDELSLFDKSVAEEAKSVLLDDKLKIRDKQIGLEKVFRVDDKIRKEIIKGLCGGKISPSILFGDEYKDEKNFSFKEISDEIFESMRDTYGDDFGLLCAIRSVYGFVTFEKLLEGHSSLSAAMIAVYEKHKNDLKRLKSFIKSERPEDYNKIFKSTEEKCNYVNNVGYTKKGGDKKKVKKCKDDEFYAYLKKYLSGLDDVKDAETRNAIIEEIEDGKFLPKILHSDNGLFPRQINESELNKIVGNMVKAYPETAAVEEKILTLFRFRIPYYVGPLSGENSWAVRKSDDKITPWNFYDVIDAAKSNEEFMRRMTNKCAYLQGEDVLPKASVLYQKFDTLNQLNKLRVNDEIISVELKKKIYNELFLVYPKVSDKKIKELLVREGRISPSDVNDTVLSGKDGEFKASMSSYIRLKKILGDFVDKDLSENGGVIENIILWHTLNTDKSIVENLIKSNYGKIPEIKNALPQLKGLTFNDFGRLSAKLLSGIYTIIAETGELRNIIDTLYETNENLNEILNDERYEFGRIINEENGQADEEVTYETVKKLYVSPAVRRGIWQAMSVTDEYVRAIGRAPDKIFIEVTRTDGKKGDAWRTQPRKRRLQEKFKALCNDGAFDDIIAELDDEKYTDMRLRQERLYLYFRQLGRCMYTGQRISLDDINDTNLYDVDHILPRTFIKDDSLDNKVLVLRSKNAQKSDTYPLPAGFSDQRGFWKLLLDKGLIEKVTYDRLTRTEPLREDEYRDFINRQKVITDQTVKAVAELMRRKYPTAKIVYSKAKNVSDFRKKFKLFKCRETNDLHHARDAYLNVVVGNVYDTVFSTPMAMFRKDGDVWRNYNLKKLFTREVKFAWNESSIAIVKKTYARPSMTVTRYAVCAKGGFYDQTIYGKGDIGITSPRKANGPLSDMSKYGGYKSQSTAYFAIVSSTDKKGNKIKTIEAVPVLTAYQAKTDNKAVEKYFADRLSTPEIIVPKLKIKQLISFNGTPCYLAGITGTRIIAHSAVQLFTDNKTDDYVNSLLNLEDMKSKKAVNVGDDKFVMKTDHTGAEKLVIDKATNIALYRDLMRRLGLKIYSGISAFATFAKNMKSGEDKFISLTVCDQATVLLQILKFFKCNAEISDITLIGGSGKSGTVLLNKNITDVDFEIINLSPAGLIERVRKV

SEQ ID NO: 8488 - protein, 1408 aa, unidentified
  REGION 1..1408: note = Description of Unknown:uncultivated organism sequence
MDKKFYLGLDIGTASVGWALTDENYELVHLRGKSAWGVHLFEEAKTAEKRRLFRSARRRKARTKRRINLLQELFSEEIAKIDPLFFIRLNNSTFFADDKDTALLGKKDTLFSDRNFTDKDFHKLYKTIYHLQKELIDDKNTKFDIRFIYLALHHLIKYRGHFYLEESFNMDEFGIHQIKEGFEKLQVFFEDEEEIKNLFNKANRDGFYSIVEKVRGVNNTKKALKDLFATKNKIVNNTLEFIASGSSTVGRLFPFLEFGEEDEKKKINFGDEEFENQYYEIEGMVGEEKIILIDAAKQLYDYIIIARLMDGEKFIAHSMVKKYNKHRDDLKRLKKIIKKACGQEEYNAFFKDNVKTVNNKPKRVTDNYPAYIGMTKIKGVKQSVKKITKADEINKFYNRIKKLISNVHTPEADKIREEIEKGVFLPKITSVDNAKIPNQFFEYQVSKILDNAAKHYPFLNKVDGELSIKDKILKILTFRIPYYVGPLSDINNLNSKEGGFSWVVRKTNETVLPWNLDKVIDLDKTAEQFILNMTNKCSYLLGEDVIPKQSLLYEEYNMLNHLNVIKVNEKFLSKDEKDELIENVAKKRVTVTQKAINDYFARRLKKDVTISGFDIDAKFSLSSYHKLNRIFPGRINNEPQNARLIRNLERVILLGTIYSSPTDFAKRVTTNKQFREFFTEEELKKLSRLRFSGWGNFSRLLLAGYDSTSKKERLNQSLTYKDEKTGNELSIIEIMREEPLNFNQALFDEKYNFNEIIKRFNDNKDETLDVDELIDSYYLSPAVKRSIKRTIKIVDEVIQVNEGIVPDKIFVEVTRENEAKTKGKGRTISRLNKLRDIYKKAIKDADEFRELAKELENENLDDSYLSPKKVYLYYLQNGKCAYSGEPLDLLSSDIDIDHIVPRCLVKDDSFDNLVLVKKEENNKKGDHYPIRTDVIRRQKPFWKQLKKLGLMSNAKYEKLTRTRELTAEDFQGFINRQLVITNQANKAVAEILKKLYGNATIVYSKASNVTNFRNQFNITKCREINNVHHAHDAYLNVVVGNYFHTLFGSRYYFSKDNDEEPWSPKTAFKYTVKGCWDKDRSLVTVMKMLKRQDVLFTRMPEIRSGEFYDQTASKAAENLLPIKESGPLTNTARYGGYSGKNAAYFTIIEHTNKKNKRERIFISMPIIINQKIKQGQTTFKEYLKNDLKLVKPKVIYPLIPFNTVIKRGKSLQFLSGYKGEFSQVYLRNMIEPYFDNFTYEYLTLIYKYFEQKSLKGKKKKKDETSEVIISEDQENQEEVQQIKEIQVIFSKDEERLRFINFKKNKKVFEKLIEKIKKPIYKKSHTERRIKIINNKNEFYKLSLERQTEIIISLHKLLKTGVPGRNDIDLAEFGVKTGELTASYKIEDMSIVKQSITGLYQKEIIIKQV

SEQ ID NO: 8489 - protein, 1386 aa, unidentified
  REGION 1..1386: note = Description of Unknown:uncultivated organism sequence
MKKQNNYYIGLDLGTNSVGWAVTNEKYELLHLKRKPAIGVNTFEKAKTAEQRRNYRSTRRRLARRKQRVLLLQTFFAEEVAKKDPTFFLRLNNSPYFKEDKHHSLQDTKFSLFNDKDFTDKDFHKKYKTIYHLQNDIISQPDKKFDIRLVYLAVHHLIKYRGNFIKQDENINVAEFTNSLVTDAFQELAHYFEDTDLIAAQNFFVNENVRKYEAIVSDKTNGGLKRATDKIFEQFEIKDKTLKTLLSLALGKVTRLNQIFSDEIVDDEQGKITIDFKSISYEEKYNYIKTVIGEVNIVLIDELKRLYDYFVISRLMDGKTLVAEAMVEKYEKHRSDLALLKKIFREHASKEDYRKVFTTLYTTDDKGKKKVITDVNYPRYIGKKSPYVIVKKGDYADFKKFLNKMFKDLGLLSLNDVIKVQEGLDDETFLPLINSKDNATIPYQFNEYQLRLILENQSKYYKFLNEKVDESSLTTLEKIMSIISFKIPYYIGPLVAEDNHPFAWVKRKSFEKVTPWNFSDVIDEATSASRFIERMTNKCTYIPTEDVLPREAILYQEYLALDVLNNLKINGEAIDNYAKQTLLTALYSNKTPLTKKRIATILAKNKNDVVAVSGIDDDVKLAFTSLHKFKAILGENQDLTIEDMEKIIFYRTIFTEQKMFNKKVDELLGHRLSEELCKKIKQLKFKEWSRFSNAFLTGFSKTLNKPVLFDEKTGEVISIIDIMRNNVLSLQQVIHHEKYGVLEALNKYNESMKTNENAFEDVYNLYLSPSVKRPVIKAIHLVDEIIKANDNKLPKKIFLEVTRHDDFARKGTKTISRKKQLDDLYKIAVKESKDLKDLMDELNKKTDADLRSRKLYLYFLQHGKCLYTGNPIALENLVMGDYDIEHIIPQSLITDDSLNNICLVESNINKAKGDVYPLPRTIVNVEKMKPFWERLMKRGFMSESKYQRLIRMSELTEEERFSFINRQLVETSQANKAVAKILEDRYGKGSVVYSKAQRVSDFRHKFKLLKQRDLNKAHHAHDAYLNIVVGNYNDAQTRLAYINKQTGKNFKFNPATAFEEKSFLDVWDKKSNLATIKAVLSRKNILFTQGTYISKGEFYDQQLSPAGEGKLTPVKESGPLSDTTKYGGYSSLNTSHFALVEIPKKRGSERRLIQVTRLHFAKIASGKMTLEEYLITYVGLENPKVIIDVIPLNSLIKRGKTIRSISGFDSGNTLIAHNHQEPFFSKDIEDSYYYLNRYLREIELREKEDTELLTSNEPYTIIIGNRNEKEKVQKIVISKESNEKTYLELAMHFAKDIYEHIFRGVNDTLLSNLDNFKTKSIYEQANIIKQLVMLLQTGALPASINLTSVGLNKSINRNRNINLIEKGDKLLIQSITGLYDKEICLA

SEQ ID NO: 8490 - protein, 1409 aa, unidentified
  REGION 1..1409: note = Description of Unknown:uncultivated organism sequence
MDKKFYLGLDIGTASVGWALTDENYELVHLRGKSAWGVHLFEEAKTAEKRRLFRSARRRKARTKRRINLLQELFSEEIAKIDPLFFIRLNNSTFFADDKDTALLGKKDTLFSDRNFTDKDFHKLYKTIYHLQKELIDDKNTKFDIRFIYLALHHLIKYRGHFYLEESLNMDEFGIHQIKEGFEKLQVFFEDEEEIKNLFNKANRDGFYSIVEKVRGVNNTKKALKDLFATKNKIVNNTLEFIASGSSTVGRLFPLLEFGEEDEKKKINFGDEEFENQYYEIEGMVGEENIILIDAAKQLYDYIIIARLMDGEKFIAHSMVKKYNKHRDDLKRLKKIIKKACGQEEYNAFFKDNVKTVNNKPKRVTDNYPAYIGMTKIKGVKQSVKKITKADEINKFYNRIKKLISNVHTPEADKIREEIEKGVFLPKITSVDNAKIPNQFFEYQVSKILDNAAKHYPFLNKVDGELSIKDKILKILTFRIPYYVGPLSDINNLNSKEGGFSWVVRKTNETVLPWNLDKVIDLDKTAEQFILNMTNKCSYLLGEDVIPKQSLLYEEYNMLNHLNVIKVNEKFLSKNEKDELIENVAKKRVTVTQKAINDYFATRRLKKDVTISGFDIDAKFSLSSYHKLNRIFPGRINNEPQNARLIRNLERVILLGTIYSSPTDFAKRVTTNKQFREFFTEEELKKLSRLRFSGWGNFSRLLLAGYDSTSKKERLNQSLTYKDEKTGNELSIIEIMREEPLNFNQALFDEKYNFNEIIKRFNDNKDETLDVDELIDSYYLSPAVKRSIKRTIKIVDEVIQVNEGIVPDKIFVEVTRENEAKTKGKGRTISRLNKLRDIYKKAIKDADEFRELAKELENENLDDSYLSPKKVYLYYLQNGKCAYSGEPLDLLSSDIDIDHIVPRCLVKDDSFDNLVLVKKEENNKKGDHYPIRTDVIRRQKPFWKQLKKLGLMSNAKYEKLTRTRELTAEDFQGFINRQLVITNQANKAVAEILKKLYGNATIVYSKASNVTNFRNQFNITKCREINNVHHAHDAYLNVVVGNYFHTLFGSRYYFSKDNDEEPWSPKTAFKYTVKGCWDKDRSLVTVMKMLKRQDVLFTRMPEIRSGEFYDQTASKAAENLLPIKESGPLTNTARYGGYSGKNAAYFTIIEHTNKKNKRERIFISMPIIINQKIKQGQTTFKEYLKNDLKLVKPKVIYPLIPFNTVIKRGKSLQFLSGYQGEFNKVYLRNMIEPYFDNFTYEYLTLIYKYFEQKSLKGKKKKKDETSEVINSEDQENQEEVQQIKEIQVIFSKDEERLRFINFKKNKKVFEKLIEKIKKPIYEKSHTVRRIKIINNKNEFYKLSLERQTEIIISLHKLLKTGVPGRNDIDLAEFGVKTGGLTASYKIEDMSIVKQSITGLYQKEIIIKQV

SEQ ID NO: 8491 - protein, 1386 aa, unidentified
  REGION 1..1386: note = Description of Unknown:uncultivated organism sequence
MKKQNNYYIGLDLGTNSVGWAVTNEKYELLHLKRKPAIGVNTFEKAKTAEQRRNYRSTRRRLARRKQRVLLLQTFFAEEVAKKDPTFFLRLNNSPYFKEDKHHSLQDTKFSLFNDKDFTDKDFHKKYKTIYHLQNDIISQPDKKFDIRLVYLAVHHLIKYRGNFIKQDENINVAEFTNSLVTDAFQELAHYFEDTDLIAAQNFFVNENVRKYEAIVSDKTNGGLKRATDKIFEQFEIKDKTLKTLLSLALGKVTRLNQIFSDEIVDDEQGKITIDFKSISYEEKYNDIKTVIGEVNIVLIDELKRLYDYFVISRLMDGKTLVAEAMVEKYEKHRSDLALLKKIFREHASKEDYRKVFTTLYTTDDKGKKKVITDVNYPRYIGKKSPYVIVKKGDYADFKKFLNKMFKDLGLLSLNDVIKVQEGLDDETFLPLINSKDNATIPYQFNEYQLRLILENQSKYYKFLNEKVDESSLTTLEKIMSIISFKIPYYIGPLVAEDNHPFAWVKRKSFEKVTPWNFSDVIDEATSASRFIERMTNKCTYIPTEDVLPREAILYQEYLALDVLNNLKINGEAIDNYAKQTLLTALYSNKTPLTKKRIATILAKNKNDVVAVSGIDDDVKLAFTSLHKFKAILGENQDLTIEDMEKIIFYRTIFTEQKMFNKKVDELLGHRLSEELCKKIKQLKFKEWSRFSNAFLTGFSKTLNKPVLFDEKTGEVISIIDIMRNNVLSLQQVIHHEKYGVLEALNKYNESMKTNENAFEDVYNLYLSPSVKRPVIKAIHLVDEIIKVNDNKLPKKIFLEVTRHDDFARKGTKTISRKKQLDDLYKIAVKESKDLKDLMDELNKKTDADLRSRKLYLYFLQHGKCLYTGNPIALENLVMGDYDIEHIIPQSLITDDSLNNICLVESNINKAKGDVYPLPRTIVNVEKMKPFWERLMKRGFMSESKYQRLIRMSELTEEERFSFINRQLVETSQANKAVAKILEDRYGKGSVVYSKAQRVSDFRHKFKLLKQRDLNKAHHAHDAYLNIVVGNYNDAQTRLAYINKQTGKNFKFNPATAFEEKSFLDVWDKKSNLATIKAVLSRKNILFTQGTYISKGEFYDQQLSPAGEGKLTPVKESGPLSDTTKYGGYSSLNISHFALVEIPRKRGSERRLIQVTRLHFAKIASGKMTLEEYLITYVGLENPKVIIDVIPLNSLIKRGKTIRSISGFDSGNTLIAHNHQEPFFSKDIEDSYYYLNRYLREIELREKEDTELLTSNEPYTIIIGNRNEKEKVQKIVISKESNEKTYLELAMHFAKDIYEHIFRGVNDTLLSNLDNFKTKSIYEQANIIKQLVMLLQTGALPASINLTSVGLNKSINRNRNINLIEKGDKLLIQSITGLYDKEICLA

SEQ ID NO: 8492 - protein, 1386 aa, unidentified
  REGION 1..1386: note = Description of Unknown:uncultivated organism sequence
MKKQNNYYIGLDLGTNSVGWAVTNEKYELLHLKRKPAIGVNTFEKAKTAEQRRNYRSTRRRLARRKQRVLLLQTFFAEEVAKKDPTFFLRLNNSPYFKEDKHHSLQDTKFSLFNDKDFTDKDFHKKYKTIYHLQNDIISQPDKKFDIRLVYLAVHHLIKYRGNFIKQDENINVAEFTNSLVTDAFQELAHYFEDTDLIAAQNFFVNENVRKYEAIVSDKTNGGLKRATDKIFEQFEIKDKTLKTLLSLALGKVTRLNQIFSDEIVDDEQGKITIDFKSISYEEKYNDIKTVIGEVNIVLIDELKRLYDYFVISRLMDGKTLVAEAMVEKYEKHRSDLALLKKIFREHASKEDYRKVFTTLYTTDDKGKKKVITDVNYPRYIGKKSPYVIVKKGDYADFKKFLNKMFKDLGLLSLNDVIKVQEGLDDETFLPLINSKDNATIPYQFNEYQLRLILENQSKYYKFLNEKVDESSLTTLEKIMSIISFKIPYYIGPLVAEDNHPFAWVKRKSFEKVTPWNFSDVIDEATSASRFIERMTNKCTYIPTEDVLPREAILYQEYLALDVLNNLKINGEAIDNYAKQTLLTALYSNKTPLTKKRIATILAKNKNDVVAVSGIDDDVKLAFTSLHKFKAILGENQDLTIEDMEKIIFYRTIFTEQKMFNKKVDELLGQRLSEELCNKIKQLKFKEWSRFSNAFLTGFSKTLNKPVLFDEKTGEVISIIDIMRNNVLSLQQVIHHEKYGVLEALNKYNESMKTNENAFEDVYNLYLSPSVKRPVIKAIHLVDEIIKANDNKLPKKIFLEVTRHDDFARKGTKTISRKKQLDDLYKIAVKESKDLKDLMDELNKKTDADLRSRKLYLYFLQHGKCLYTGNPIALENLVMGDYDIEHIIPQSLITDDSLNNICLVESNINKAKGDVYPLPRTIVNVEKMKPFWERLMKRGFMSESKYQRLIRMSELTEEERFSFINRQLVETSQANKAVAKILEDRYGKGSVVYSKAQRVSDFRHKFKLLKQRDLNKAHHAHDAYLNIVVGNYNDAQTRLAYINKQTGKNFKFNPATAFEEKSFLDVWDKKSNLATIKAVLSRKNILFTQGTYISKGEFYDQQLSPAGEGKLTPVKESGPLSDTTKYGGYSSLNISHFALVEIPKKRGSERRLIQVTRLHFAKIASGKMTLEEYLITYVGLENPKVIIDVIPLNSLIKRGKTIRSISAFDSGNTLIAHNHQEPFFSKDIEDSYYYLNRYLREIELREKEDTELLTSNEPYTIIIGNRNEKEKVQKIVISKESNEKTYLELAMHFAKDIYEHIFRGVNDTLLSNLDNFKTKSIYEQANIIKQLVMLLQTGALPASINLTSVGLNKSINRNRNINLIEKGDKLLIQSITGLYDKEICLA

SEQ ID NO: 8493 - protein, 1386 aa, unidentified
  REGION 1..1386: note = Description of Unknown:uncultivated organism sequence
MKKQNNYYIGLDLGTNSVGWAVTNEKYELLHLKRKPAIGVNTFEKAKTAEQRRNYRSTRRRLARRKQRVLLLQTFFAEEVAKKDPTFFLRLNNSPYFKEDKHHSLQDTKFSLFNDKDFTDKDFHKKYKTIYHLQNDIISQPDKKFDIRLVYLAVHHLIKYRGNFIKQDENINVAEFTNSLVTDAFQELAHYFEDTDLIAAQNFFVNENVRKYEAIVSDKTNGGLKRATDKIFEQFEIKDKTLKTLLSLALGKVTRLNQIFSDEIVDDEQGKITIDFKSISYEEKYNDIKTVIGEVNIVLIDELKRLYDYFVISRLMDGKTLVAEAMVEKYEKHRSDLALLKKIFREHASKEDYRKVFTTLYTTDDKGKKKVITDVNYPRYIGKKSPYVIVKKGDYADFKKFLNKMFKDLGLLSLNDVIKVQEGLDDETFLPLINSKDNATIPYQFNEYQLRLILENQSKYYKFLNEKVDESSLTTLEKIMSIISFKIPYYIGPLVAEDNHPFAWVKRKSFEKVTPWNFSDVIDEATSASRFIERMTNKCTYIPTEDVLPREAILYQEYLALDVLNNLKINGEAIDNYAKQTLLTALYSNKTPLTKKRIATILAKNKNDVVAVSGIDDDVKLAFTSLHKFKAILGENQDLTIEDMEKIIFYRTIFTEKKMFNKKVDELLGHRLSEELCKKIKQLKFKEWSRFSNAFLTGFSKTLNKPVLFDEKTGEVISIIDIMRNNVLSLQQVIHHEKYGVLEALNKYNESMKTNENAFEDVYNLYLSPSVKRPVIKAIHLVDEIIKANDNKLPKKIFLEVTRHDDFARKGTKTISRKKQLDDLYKIAVKESKDLKDLMDELNKKTDADLRSRKLYLYFLQHGKCLYTGNPIALENLVMGDYDIEHIIPQSLITDDSLNNICLVESNINKAKGDVYPLPRTIVNVEKMKPFWERLMKRGFMSESKYQRLIRMSELTEEERFSFINRQLVETSQANKAVAKILEDRYGKGSVVYSKAQRVSDFRHKFKLLKQRDLNKAHHAHDAYLNIVVGNYNDAQTRLAYINKQTGKNFKFNPATAFEEKSFLDVWDKKSNLATIKAVLSRKNILFTQGTYISKGEFYDQQLSPAGEGKLTPVKESGPLSDTTKYGGYSSLNTSHFALVEIPKKRGSERRLIQVTRLHFAKIASGKMTLEEYLITYVGLENPKVIIDVIPLNSLIKRGKTIRSISGFDSGNTLIAHNHQEPFFSKDIEDSYYYLNRYLREIELREKEDTELLTSNEPYTIIIGNRNEKEKVQKIVISKESNEKTYLELAMHFAKDIYEHIFRGVNDTLLSNLDNFKTKSIYEQANIIKQLVMLLQTGALPASINLTSVGLNKSINRNRNINLIEKGDKLLIQSITGLYDKEICLA

SEQ ID NO: 8494 - protein, 1389 aa, unidentified
  REGION 1..1389: note = Description of Unknown:uncultivated organism sequence
MKKTYLGLDIGTNSVGWALTNENYELIHLRGKSAWGVHMFDEANTAKERRNYRSTRRRKARIKRRINLLQDLFAAEMAKVDPLFFTRLNNSTFFSEDKDKALLGKKDSLFSDKNFTDKDFYKNEKTKTIYHLQKLLIDDKNTKYDLRFIYLAIHHLIKYRGHFHFEGQNINIDEFGKNQIKEGFEIINDYLSMNNLTTFVFSADKIIGFEKIVENERGINNTKKALKDLFNTKEKIVVNILDFIANGKVKLKKIFDNLELQEEENFEIDFSVEDFETQYVEAEAIIGEEHIVLIDAVKQLNDYLVVARLMNGEKFVAHAMVKKYNKHKEDLRKLKKIIKENCSQEQYDTFFKAADQENNYPAYIGMTKIRGARHKIKKLEKPSEINKFFRNINEIIKNIHSDSANNIREEIEKGIFLPRITSVENSQIPHQFNAYQLEIILNNSAKHYPFLNKKEEGLTLKEKIIKLLTFRVPYYVGPLSDKHQIDSKKGGFSWIVRKSNKEVLPWNLDKVIDLEKTAEQFILKMTNKCSYLIGEDVLPKQSLLYEEYNLLNHFNVIRINGERLSKVEKEALIENIAKKRVNVTYQTIAKYFDNRLKKDVTITGIDEEMKLSLSSFHKFNKIFPGRINNEPQNAKLMRNLEKIVFLGTIYSSQVDFTNRLKSDKEFNKFFSTEEISKMANLRFKGWGSFSRLLLTGFDELSKSNDKVITYQDEKTGNELSIIEIMREEPLNFNEVLFHEKYQFSKLISEFNHEGDSELSVDELIDNYYVSPAVRRSIRRTLKIVDEVIATNNGIIPDKIFVEVTREDEKTRKGKGRTDSRLEKMRNIYKKAIKDAEEFRVLLDEISKDDKNDDYLRPKKMYLYYLQNGKCAYTGEPLNLKDASIDHIIPRSLVKDDSFDNLVLVKDTVTNQRKTDEYPLNFDIIQKQKPLWLKLKRNGLMSNVKYEKLTRTRELTAEDFEGFVNRQLVITNQANKAIAEILKTKYGVSTIVYSKASNVTDFRQKFNLIKGREINNAHHAHDAYLNIVVGNYFNTRFGARYYYRDDKKFKWNPKTAFNFNVGGCWDKDKDLGTVKKMLNRRDILFTRMPIIETGQFYNQKASKAGDNLIPIKEKGPLSDTTKYGGYSDKKTAYFAIIEHTAGNKRERIFIPIPVIINQKIIQKQTTLVEYLKTQLKLVEPNIIYSPIPINTIVKRGQSLQFISGVQGSGATHLIVRNMIEPYFDDLTFEYLCLINKYFERKAAAKVTNEDEQLSRENIEKIQVIFSFNEKEKTRKNDRLRYITRDKNEKAFECLIKQIEKPIYEKSFGSRREKILENMEKFYDLKLVRQVEIIRALHEFLKTGVPAIKIKLEELGVKSGTLTMSYKLEDMTIVKQSITGLYQKEIHIKEV

SEQ ID NO: 8495 - protein, 1347 aa, unidentified
  REGION 1..1347: note = Description of Unknown:uncultivated organism sequence
MNTFEKAKTAEQRRNYRSTRRRLARRKQRVLLLQTFFAEEVAKKDPTFFLRLNNSPYFKEDKHHSLQDTKFSLFNDKDFTDKDFHKKYKTIYHLQNDIISQPDKKFDIRLVYLAVHHLIKYRGNFIKQDENINVAEFTNSLVTDAFQELAHYFEDTDLIAAQNFFVNENVRKYEAIVSDKTNGGLKRATDKIFEQFEIKDKTLKTLLSLALGKVTRLNQIFSDEIVDDEQGKITIDFKSISYEEKYNDIKTVIGEVNIVLIDELKRLYDYFVISRLMDGKTLVAEAMVEKYEKHRSDLALLKKIFREHASKEDYRKVFTTLYTTDDKGKKKVITDVNYPRYIGKKSPYVIVKKGDYADFKKFLNKMFKDLGLLSLNDVIKVQEGLDDETFLPLINSKDNATIPYQFNEYQLRLILENQSKYYKFLNEKVDESSLTTLEKIMSIISFKIPYYIGPLVAEDNHPFAWVKRKSFEKVTPWNFSDVIDEATSASRFIERMTNKCTYIPTEDVLPREAILYQEYLALDVLNNLKINGEAIDNYAKQTLLTALYSNKTPLTKKRIATILAKNKNDVVAVSGIDDDVKLAFTSLHKFKAILGENQDLTIEDMEKIIFYRTIFTEKKMFNKKVDELLGHRLSEELCKKIKQLKFKEWSRFSNAFLTGFSKTLNKPVLFDEKTGEVISIIDIMRNNVLSLQQVIHHEKYGVLEALNKYNESMKTNENAFEDVYNLYLSPSVKRPVIKAIHLVDEIIKANDNKLPKKIFLEVTRHDDFARKGTKTISRKKQLDDLYKIAVKESKDLKDLMDELNKKTDADLRSRKLYLYFLQHGKCLYTGNPIALENLVMGDYDIEHIIPQSLITDDSLNNICLVESNINKAKGDVYPLPRTIVNVEKMKPFWERLMKRGFMSESKYQRLIRMSELTEEERFSFINRQLVETSQANKAVAKILEDRYGKGSVVYSKAQRVSDFRHKFKLLKQRDLNKAHHAHDAYLNIVVGNYNDAQTRLAYINKQTGKNFKFNPATAFEEKSFLDVWDKKSNLATIKAVLSRKNILFTQGTYISKGEFYDQQLSPAGEGKLTPVKESGPLSDTTKYGGYSSLNTSHFALVEIPKKRGSERRLIQVTRLHFAKIASGKMTLEEYLITYVGLENPKVIIDVIPLNSLIKRGKTIRSISGFDSGNTLIAHNHQEPFFSKDIEDSYYYLNRYLREIELREKEDTELLTSNEPYTIIIGNRNEKEKVQKIVISKESNEKTYLELAMHFAKDIYEHIFRGVNDTLLSNLDNFKTKSIYEQANIIKQLVMLLQTGALPASINLTSVGLNKSINRNRNINLIEKGDKLLIQSITGLYDKEICLA

SEQ ID NO: 8496 - protein, 1193 aa, unidentified
  REGION 1..1193: note = Description of Unknown:uncultivated organism sequence
MFSADKILGFERIVKDERGINDTKKALKVLFNTKEKIVVNILDFIANGKVKLKKMFDNLELTEEEEKFEIDFSVEDFEAQYVEVEAIIGEEHIVLIDAVKQLNDYLIVARLMNGEKYVAHAMVKKYNKHKEDLRKLKKLIKENCGQEQYNSFFKAADQEYNYPAYIGMTKIKGTRHKTKKIVKPSEITNFFTNIKEIIKNIKSDSANNIREEIEKGIFLPRITSVENSQIPYQFNAFQLEKILNNSAKHYPFLNKKEDGLTLKEKIIKLLTFRVPYYVGPLSDKHNVDNKEGGFSWVVRKNNKEVLPWNLDEVIDLEKTAERFILNMTNKCSYLIGEDVLPKQSLLYEEYNLLNHFNVMRINGERLSKEEKEALIENVAKKRVNITYQTIAKYFDNRLKKDVTITGIDENVKLSLSSFHKFNKIFPGRINNEPQNANLMRYLEKIIFLGTIYSSQVDFTNRVKSDKKFSKFFSTEEINKMASLRFKGWGSFSRLLLTGFDELSNSENNDKALTYQDEKTGNELSIIEIMREESLNFNEVLSHEKYQFSKLIGKFNYTGKSELSVDELIENYYISPAVQRSIRRTLKIVDEVIDTNDGIIPDKIFVEVSREDEKTRKGKGRTDSRLKRIRKIYEKAIKDAEEFRILHDEISKDDKNDVYLRPKKMYLYYLQNGKCAYTGEPLDLKIASIDHIIPRSLVKDDSFDNLVLVKDTTTNLRKTDEYPLNFDIIQKQKPLWSKLKRNGLMSNVKYEKLIRTKELTPEDFENFVNRQLVITNQANKAIAEILKVKYGRATIVYSKASNVSDFRQKFKLIKGREINNAHHAHDAYLNIVVGNYFNTRFGARYYYRDDKKIKWNPKTAFNFSVKGCWDKDKDLGTIRKMLKRRDILFTRMPIIESGQFYNQKASKAGDNLIPIKETGPLSDTTKYGGYSDKRSAYFAIIEHTAGSKRERIFIQVPVIINQKIKQGQTTLLEYLKTQLKLVEPNIIYSPIPINTVIKRGQSLQFISGVQGKDANQLIVRNMVEPYFDDFTSEYLCLINKYIERKKETKKTNKDEQLTEENIEKIQVIFTFNGEGRTRKNDRLRYITRDKNKRAFECLIKQIEKPLYEKSHSDRRKKILENKEKFYDLKLVRQVEIVRALHELLKSGVPPSKINLEELGVKSGKLTMSYKLKDMVIVKQSITGLYQKEIHIEEV

SEQ ID NO: 8497 - protein, 1353 aa, unidentified
  REGION 1..1353: note = Description of Unknown:uncultivated organism sequence
MKERSDYYLGFDIGTNSVGWAVTDENYRIQKFNGKLMWGSRLFDEANTAQERRMHRTLRRRLQRRRWRINLLQELFAEEISIVDVGFYQRLKDGALLPEDKSENQIYTLFHDADFNDTQFYEKYPTIYHLRKALITETDKKDIRLIYLALHHIMKHRGHFLFSGTVENATSFQCAYDNMVRCLEDEFDMTLSCDDRDELSKIIRDKRITKRDKASRILSLWHCEDEDRQKQWKAMIGMICGSKVKLAEVFADDTLKEADRPSISFADTSYDEIYPELEEILQERCGILDILKGVYDWGILADILKGGEYDGNSYLSIAKVGIYEKHKKDLRCLKSVLRDFANDTYRDFFQRPGKDNYCAYIGTTLRNGKKSSSKRCSYDDFKKATKKILEGIQAEDGDERIDYILEELEQGTFLPLQVSKENSVIPHQVHAMECRAILQNAEKHYDFLREKDEKGRTVSERIVQLFEFRIPYYVGPLNTSNKGNSWMIRKEGAEGRIDPWNFEEMVDTNASAEQFIRRMTNKCTYLRGEDVVPKYSLLYSEFMVWNELNNVKIRSEKLPTEMKTRIFDEVFQKNKKITGKTLLTYLQCEGIEVEASDLSGFDQTFKSSLTSYLDMKKIFGEEIQKFSCREMAEDLILWITLYGDAPKMLRQVIRNHYGEDRLSEEQLKKVCRLKYQGWGRLSKKFLNGIEGVSVETGETFTILRALRETNDNLMQILSSNYTFSKEIEAINKEKFQNIVSFSYDNIMKDTVASPAIKRAAWQVLLIAEEVRKIMGKEPLKIFVEMARGPEEKKATTSRQQRLLQLYAKIKDESREWKAELENRKESDFRSIKLYLYYTQMGKCMYSGKSLDLSQLANLEVCDRDHIYPQSKTKDDSLDNLVLVCSEYNRAKGDGMIKPEWQKKMTPFWQMLKNKGLISENKFRRLTRQTPLTDEELAGFINRQLVETRQSSKVVTELFQRLYENSQVVYVKAKAVSDFRHQTLEMVKCRSINDYHHAHDAYLNIVVGNVYHEKFTSNPLRWLREKKDYNYSLNRMFDWNLERRGRIIWEKGKKGTIQTVRHYMKQKDIRYTRYATENKSGQNGGLFDSQIVGKNENASIPIKKGMDVKKYGGYKTITPAYFALVQSVDKKGKLQKSVEAVPLYLKREVENNPERYLEYCRQEYGLKEPKILIPRIKKDSLFRINGFPMHLRGRQDTRLLLQGAVQLILDKDYEVYYKKIEKYLQRDQQNARERLSITERDEITSERNLWLYDELYRKQSETIYRYRPNSQCRILADGRERFLELSCEEQCAVLNEILHLLQCKSIMANLKMVGGSGLAGKILVNKVITKCNEAKLIHQSVTGLFEQEIDLLAL

SEQ ID NO: 8498 - protein, 1353 aa, unidentified
  REGION 1..1353: note = Description of Unknown:uncultivated organism sequence
MDLQKDYYLGLDCGTGSVGWAVTDTDYRVLAFRGKSMWGSRLFETALTAADRRMNRCARRRYLRSKQRIDLLDELLEEEIAKTDPEFIQRVKDSSYKKSDKTEVQKNSLFNDKKFKDNDFFNKYPTIFHLRKALIDNPPDDIRFLYLAIHHILKNRGHFLFPGQSLSSIQSLKPLLEKMCCLSEDELGVSIYINDYEEAERCIKEYKGNQRVFKLEEIITTSDSKVLKKILKTLSGQKVNASDLFDNEELIIDGQEIKIDFQKADFETAELVALEDLLSEESYLLLEQLKGIFDWSLLSRVMAGCVYLSDAKINQYNDNKVDLKNLKYIYKTYFTEKEYEEFFHSEKLNTFSSYIGGMYDQRIKLSVRRTKMDDFYKVVKKMIESCASAKNDPIGQQILNKIADGSFFNLLISSRNSLIPYQVHYMELAKILENAEKQFSFLTVKDDDGLTISDKIKSIMTFRIPYYVGPLVDVSKPENARKFAWMTRKSEGKIYPWNFEEKVDIATSATNFITKMVNNCTYLPNEKVLPKNSLLYSEFMVLNELNNLKINSEKPSVEQKQEIVEKLFKKYKKVTQKRLLEFIKTEGWYPNNTQLQITGIDGDFKTSLTSYIAFKNYLNNHVLSKAEVEEIIFYNAVFESGGSILEDKITTLIGDKVSNEDLKKILAIKFKGWGRFSRKFLECLDGTELATGEVHSIMYFLQNTNKNLMELLSKDYDFLEGIEELQTGAIENLDYSCVEQLSISPSVKRQIWQTLKIVKEVEKIMGSQPKKVFMEFAREEREKVRTVSRRDNLLKLYDSLVNPSEEDLELKRKIVNCTDTQLAKNDRLFLYYTQLGRCMYSGKPIDISELTNSNIYDIDHIIPQSKIKDDSLNNKCLVLRTINNGVKNDIYPITDSIQNTQKQFWKHLLDCHLINENKYNRLIRTKQLSESELSDFINRQLIETQQSTKACASILKQYFKEGTKIVYSKAGNVSDFKNEYFIPKVRIINDLHHAKDAYLNIVVGNCFDTKFSRPGFIQSHEQYNLSHVFKYSINGAWDKDKTIKLVKEQLDNNDIRFTRQTFCKSGQLFDLMPLKGNEKNGMIPRKSSDPKLVELLSKAEDKDKCIEDWVKQYGGYNSLAISYFALIKYTEKKKDKAVIISIPVMLANQIKTDDELLAYASNKLKFANPRIIIRKILVNTLFEYNGFRLHLSGKAGSSIVFKNATPLYLTKDLEKYTKNLEKVNNRKKRFPNTFKLYPEEDKISKEENLLLYDELTRKLGIKPFSNRPGGFFEKLQNGRSLFIELNCEEQVFELIEILQLFGTNSTLSNLSAIGCAKTAGGINISPNLDISKNKYVIINQSVTGLFEKTERLG

SEQ ID NO: 8499 - protein, 1344 aa, unidentified
  REGION 1..1344: note = Description of Unknown:uncultivated organism sequence
MKLEEIDYYLGLDCGTSSVGYAVTDKDYNLLKARHKDMWGSHLFDEAETAEGRRIQRNARKRLQRRKERIKLLQSIFAEEIAPIDPTFFLRLNESSLWEEDRSSENKQSFSLFNDSGFTDKDYFKKYKTIYHLRSDLVSSTEERDPRLIYLALHHIVKNRGHFLFPGDSFSSVTDISPVLDALKESYYSVFDEELTIPDNNSIVDCLYEKVKSIRVEKLKASIFSENDKRKTNLVKAIVGYKIQAKNLFENEEYEELPAIEFSNNSFEENSLPTLEESLSDDEYKLIESLKALYDWALLSSIMSGKRFISEAKVELYEKNKRDLKDLKDLVKEYAPESYQDLFHGDKESFSNYIGFNRTNKKSQNKRVKRVSTENFYKKVKKILGTIVTDDPRKTRILEDIENDNFLVLLRSFRNGVIPYQVNKAEMEQILENASTYLPWLKVRDKDGNTPKSKILSILTFRIPYYVGPLNGHNNKNYWMIRKDDGKIYPWNFDKKVDEIASAESFIQRMTNKCTYLPTEDVVAKQSLLYQKFMVLNEINNIKINGEDISVEQKQDIYSLFKQGNVTRKKIEKLAVSKCWVQNGESISIDGIDETIKSKLSSYLTFKDYLESGKLTEADVDTIIYYLTLFSDGGKIVKSKLSSLFKDKLSEKELDKISRLKFSGWGNLSKKFLAGIEAMNPETGELTNIIGLLWDTNYNLMELIHNEATGIQNALNNKKQIPSLSYELLDEYRLSPKVKRQIWQALKIVKEIEKIMGHKPNKIFIETTRSNSSKKKGKRDESREDKLRKLLKDDTDSEIKEIYNILESNSKDTGKITSRNKRDKFYLYLTQLGKCMYSGEKIEIANLFTADYDVDHIYPYSKSKDDSLTNKVIVKSNLNREKSNIYPISEGIINKMTPFWKKLESMELIPSEKLYRLTRRTPLTDKELQDFINRQIVETSQTTVTLARILKNYYGESKVVYSKAGNVSKFREDKKIFKSRTINDLHHARDAYLNIVVGNTLNTKYTSKFFLQEQNRDDSNSFNFNFNSNVEGAWMADNNTSMNVVKATMEKNTVLFTKQPEMRTGKLFEVKLKSKGQELGMIPSKMSDYYKAGASLFKEWTDKYGGYNSLAISHFSLVKHKEKKSYVYTFVSIPMIRAKELLNRENLEKYCKDELMYEDFEIVREKVLFNTLLSVDGFLMTITSSDSGGDKICLESAVPLLLNNDLTEKVKKLVKHAKKTKDKNVIGYEDLDGISKSSNEKIYELLLKKAKLPIYKSRPANAIKVLESGYERFKNLTLEDQISALTSILDYFGMRNGIADLQLVGGKANSGKIRIQATVNPSKKRVFIIDQSITGIYDSWFELK

SEQ ID NO: 8500 - protein, 1351 aa, unidentified
  REGION 1..1351: note = Description of Unknown:uncultivated organism sequence
MNLKEIPYYVGLDCGTSSVGFAVTDKNYNLLKAKNKDMWGSHLFDEANTAEARRIQRNARKRLARRNERIKLLQSIFAEEIAKIDPTFFIRLNESSLYQEDRSKDNDQPFSLFNDKDYTDKDFKIDFPTIYHLRAALLDGSITKKDPRFVYLALHHIVKNRGHFLFPGESLASIQNIGTILQALKECSSSIFEEDLTFGSQNLIEDALKIKKKTERIETLKSLIFSNNDKRKLLIIKAIAGYSIQPKNLFENDEYDELPKLEFQKSSFEEQDLPKLEETLQEDEYKFVESLKALYDWSLLANIMAGKDSISKAKIDQYNKNKQDLTVLKKVIRKYFTKEEYEAFFHSNKEGSFSNYIGSINSKHLAKGPEHKTRKRVKRTNTDVFYAEVKKTLKKITVEDSDVNQILSDIENDNFLPLLRSFRNGVVPFQVNLAELKGILEKSEGYLPWLEKKDEDGLSAEDKIISIMKFRIPYYVGPLADPSKNRNAWLARKESGRILPWNFEKKVDVGESAERFIMRMTNKCTYLPEEDVIPKQSLLYQNFMVLNEINNLKINSEDISVEQKQTIYYKLFRKGNVTQKKIKNLAITEGWVQKGDDLILSGIDDTIKASLSSYIAFAPYLESGKLNQNEVEDIIRWLTLFSDGGDIAKRKIESTFSGKLSKDDIKAISRMKFSGWGNLSKKFLTGIDAIDPETGEYKNIIRLLWDTNYNLMEILHNPECGILEQLGNKEPIDSLNYSILGDLRISPKVKRQIWQALRITKEIEHIMGHKPEKVFIEVARYEGEKGKRTKTRKDQLLEKIKKAKDPDDNEILKSLESEDVSMITKRDRLYLYYTQLGKCMYSGEDIDLDDLLSKKYDIDHIYPYSKSNDDSLTNKVIVKSELNTEKRNDFPIKEDIRIKMNKFWKKLLEKELISSEKYHRLTRNTSLSDEDLKGFINRQIVETSQSTKALAEILKRYFGEETKIVYSKAGNVSDFRKDFDLPKSRIINHLHHAKDAYLNIVVGNTLYCKYTSAWFLKNVNFNNPYKYNVEGAWIADSNKTISLVKATMDKNTVLFTRQPEMRTGQLFDLNPKAKGSEKGMIPLKMIPKLKEQLSKNTNKEEIIKAWTDKYGGYNSLAVSHFALVRHLEKKKQVYTFVKIIVIRAQELLDKENLLKYCVEELGYKDVEIIRTKVLFNTLLSVDDFLMTITNSMNKGATLGNESAIPLILENKYVKYVKKLEKFTNAKRLDKNLLIDEKYDEISREENIELYELLLKKCKLYIMRNRPGNSTGIIERGEEVFTNLPIEQQTQTLMNILNYLSMGNGCTDFSLIGGGKANGTLTLSSTIDPSKKKVCIFDQSITGIYEERLKLE

SEQ ID NO: 8501 - protein, 1353 aa, unidentified
  REGION 1..1353: note = Description of Unknown:uncultivated organism sequence
MNLKEIPYYVGLDCGTSSVGFAVTDKNYNLLKAKNKDMWGSHLFDEANTAEARRIQRNARKRLARRNERIKLLQSIFAEEIAKIDPTFFIRLNESSLYQEDRSKDNDQPFSLFNDKDYTDKDFKIDFPTIYHLRAALLDGSITKKDPRFVYLALHHIVKNRGHFLFPGESLASIQNIGTILQALKECSSSIFEEDLTFGSQNLIEDALKIKKKTERIETLKSLIFSNNDKRKLLIIKAIAGYSIQPKNLFENDEYDEIPKLEFQKSSFEEQDLPKLEETLQEDEYKLVESLKALYDWSLLANIMAGKDSISKAKIDQYNKNKQDLTVLKKVIRKYFTKEEYEAFFHSNKEGSFSNYIGSINSKHLAKGPEHKTRKRVKRTNTDVFYAEVKKTLKKITVEDSDVNQILSDIENDSFLPLLRSFRNGVVPFQVNLAELKEILEKSEGYLPWLEKKDEDGLSAEDKIISIMKFRIPYYVGPLADPSKNRNAWLARKESGRILPWNFEKKVDVGESAERFIMRMTNKCTYLPEEDVIPKQSLLYQNFMVLNEINNLKINSEDISVEQKQTIYYKLFRKGNVTQKKIKNLAITEGWVQKGDDLILSGIDDTIKASLSSYIAFAPYLESGKLNQNEVEDIIRWLTLFSDGGDIAKRKIESTFSRKLSKDDIKAISRMKFSGWGNLSKKFLTGIDAIDPETGEYKNIIRLLWDTNYNLMEILHNPECGILEQLGNKEPIDSLNYSILGDLRISPKVKRQIWQALRITKEIEHIMGHKPEKVFIEVARYEGEKGKRTKTRKDQLLEKIKKAKDPDDNKILKSLESEDASMITKRDRLYLYYTQFGKCMYSEEDIDLDDLLGKCNKYDIDHIYPYSKSNDDSLTNKVIVKSELNREKSNDFPIKEDIRIKMNKFWKKLLEKKLISSEKYHRLTRNTSLSDEDLKGFINRQIVETSQSTKALAEILKRYFGEETKIVYSKAGNVSDFRKDFDLPKSRIINHLHHAKDAYLNIVVGNTLYCKYTSAWFLKNVNFNNPYKYNVEGAWIADSNKTISLVKATMDKNTVLFTRQPEMRTGQLFDLNPKAKGSEKGMIPLKMIPKLKEQLSKNTNKEEIIKAWTDKYGGYNSLAVSHFALVRHLEKKKQVYTFVKIIVIRAQELLDKENLLKYCVEELGYKDVEIIRTKVLFNTLLSVDGFLMTITGSSSGDSQLSLESAIPLILENKYVKYVKKLEKFTNAKRLDKNLLIDEKYDEISREENIELYELLLKKCKLYIMRNRPGNSTGIIERGEEVFTNLPIEQQTQTLMNILNYLSMGNGCTDFSLIGGGKANGTLTLSSTIDPSKKKVCIFDQSITGIYEERLKLE

SEQ ID NO: 8502 - protein, 1351 aa, unidentified
  REGION 1..1351: note = Description of Unknown:uncultivated organism sequence
MYPDYFIGIDAGTDSVGWAVTDEQYNILKFGKKAMWGIRLFDEANPAAERRLYRTQRRRYGRRVQRTKLLQELFAEEIAKKDPGFFLRMKESKYLPEDRKYDFKYLLFNDDNYTDSNFHKEYPTVYHLRKAFLDGKNINDPRLLYLAVHHIIINRGHFLFDGVNVENVTKFETVFNSLVEYINDNFDTESDIKKITNIDTAEFSKILKSKDTVTAKKKKLYELFGVKKGQLKAVCDLLAGSSSVKLSELFDNETLDSAEKNKITFSGSSYQDEHDSYEEVLDDGVIFIDLLKSVYDWSVLADILGDNAYISQSKVKSYDKHGDDLKLLKKVINRHCRDKYFDFFKSDKNDKNYCAYSGMCKIGGKKKEIKRVKQDDFYAEIKKMLKPFDDDNDVKIILADIETKSFLPKQISPDNCAIPYQLNEFELKRILLNAEKNFPFLKEKDESGIAVNDKIMKLLTFRIPYYVGPVNDEHKGENSNCWMVRSDNSKDRITPWNFENKVDIEQSAQEFILRMTNKCTYLYGEDVLPKNSLLYSEYEVLNELNNLSLNGERLNVEDKKDIIEKIFKQKNKVKIKDIVNYYCSLGKEVSADDFSGLADMKEFKSSLKSYRDFDKILGDRFNYNFVEEAILAVLLFSGDKKILTSRLKKIGSGYFTDDEIKKISSLRYSDWGRFSKKLLTGIYSVYSQTGEYMNIITAMRETTCNFMETQGQNFGFKDEIQKINSEVMPKINDFSYDALVKDLYVSPKIKRSVWQTLLIVREIVKITGHEPKKIFIEMARGSDGTSKTPDSRKNRLLELYKKCGEDSGVLYDSLSKHTDSDLRKTALYLYYTQMGKCMYSGEDIELDDLFNKNIYDIDHIYPQSKTKDDSLDNKVLVKKKLNLDKSDKFPIPSHIITDKARENWIACKNAGLISKEKYERLTRKTELTADELAGFINRQLVETRQSTKAVAGIFTEMFPDTLIVYAKASNADVFKKHFDIPKVREVNDYHHARDAYVNIVVGNVFDVKFTRNAVRFIKSGKQYSLNECMYNYPVGNKDNPAWIPGDDGTIATVKKTCSKENILYTRMPYTQGGTLYDVQLLKKGKGQFPAKPGDCHFDGQTNEEIINKYGGYNKIKGAYFCLVEHMDKKNKRVRSIEYVPVYLADSIEKNPSLLEKYVSETLGLKDADVRIRRIKMDSLFSYNGFLMNLSGRTGDRLLFKSAVQLKLNSGDYKYLKNIVKFHDRQRIMKNTLTVSDFDDITKDKNLELYDVLLSKLKDSVYCTVYLAPLKLLTEKREKFISLSVELQAELLYNALHLFQCNRVNSDLSLLGGSPNSGIILIQKTVTDKNKECLINQSPTGLFENKIDLKTI

SEQ ID NO: 8503 - protein, 1344 aa, unidentified
  REGION 1..1344: note = Description of Unknown:uncultivated organism sequence
MKLEEIDYYLGLDCGTSSVGYAVTDKDYNLLKARHKDMWGSHLFDEAETAEGRRIQRNARKRLQRRKERIKLLQSIFAEEIAKIDPTFFLRLNESSLWEEDRSSENKQSFSLFNDLDFTDKDYFKKYKTIYHLRADLASSAEERDPRLIYLALHHIVKNRGHFLFPGDSFSSVTDISPVLDALKESYYSVFDEELTIPDNNSIVDCLYEKVKSIRVEKLKASIFSENDKRKTNLVKAIVGYKIQAKNLFENEEYEELPAIEFSNNSFEENSLPTLEESLSDDEYKLIESLKALYDWALLSSIMSGKRFISEAKVELYEKNKRDLKDLKDLVKEYAPESYQDLFHGDKESFSNYIGFNRTNKKSQNKRVKRVSTENFYKKVKKILGTIVTDDPRKTRILEDIENDNFLVLLRSFRNGVIPYQVNKAEMEQILENASTYLPWLKVRDKDGNTPKSKILSILTFRIPYYVGPLNGHNNKNYWMIRKDDGKIYPWNFDKKVDEIASAESFIQRMTNKCTYLPTEDVVAKQSLLYQKFMVLNEINNIKINGEDISVEQKQDIYSLFKQGNVTRKKIEKLAVSKCWVQNGESISIDGIDETIKSKLSSYLTFKDYLESGKLTEADVDTIIYYLTLFSDGGKIVKSKLSSLFKDKLSEKELDKISRLKFSGWGNLSKKFLAGIEAMNPETGELTNIIGLLWDTNYNLMELIHNEATGIQNALNNKKQIPSLSYELLDEYRLSPKVKRQIWQALKIVKEIEKIMGHKPNKIFIETTRSNSSKKKGKRDESREDKLRKLLKDDTDSEIKEIYNILESNSKDTGKITSRNKRDKFYLYLTQLGKCMYSGEKIEIANLFTADYDVDHIYPYSKSKDDSLTNKVIVKSNLNREKSNIYPISEGIINKMTPFWKKLESMELIPSEKLYRLTRRTPLTDKELQDFINRQIVETSQTTVTLARILKNYYGESKVVYSKAGNVSKFREDKKIFKSRTINDLHHARDAYLNIVVGNTLNTKYTSKFFLQEQNRDDSNSFNFNFNSNVEGAWMADNNTSMNVVKATMEKNTVLFTKQPEMRTGKLFEVKLKSKGQELGMIPSKMSDYYKAGASLFKEWTDKYGGYNSLAISHFSLVKHKEKKSYVYTFVSIPMIRAKELLNRENLEKYCKDELMYEDFEIVREKVLFNTLLSVDGFLMTITSSDSGGDKICLESAVPLLLNNDLTEKVKKLVKHAKKTKDKNVIGYEDLDGISKSSNEKIYELLLKKAKLPIYKSRPANAIKVLESGYERFKNLTLEDQISALTSILDYFGMRNGIADLQLVGGKANSGKIRIQATVNPSKKRVFIIDQSITGIYDSWFELK

SEQ ID NO: 8504 - protein, 1224 aa, unidentified
  REGION 1..1224: note = Description of Unknown:uncultivated organism sequence
MENKKRVYPDYFIGIDAGTDSVGWAVTDEQYNILKFGKKAMWGIRLFDEANPAAERRLYRTQRRRYGRRVQRTKLLQELFAEEIAKKDPGFFLRMKESKYLPEDRKYDFKYLLFNDDNYTDSNFHKEYPTVYHLRKAFLDGKNINDPRLLYLAVHHIIINRGHFLFDGVNVENVTKFETVFNSLVEYINDNFDTESDIKKITNIDTAEFSKILKSKDTVTAKKKKLYELFGVKKGQLKAVCDLLAGSSSVKLSELFDNETLDSAEKNKITFSGSSYQDEHDSYEEVLDDGVIFIDLLKSVYDWSVLADILGDNAYISQSKVKSYDKHGDDLKLLKKVINRHCRDKYFDFFKSDKNDKNYCAYSGMCKIGGKKKEIKRVKQDDFYAEIKKMLKPFDDDNDVKIILADIETKSFLPKQISPDNCAIPYQLNEFELKRILLNAEKNFPFLKEKDESGIAVNDKIMKLLTFRIPYYVGPVNDEHKGENSNCWMVRSDNSKDRITPWNFENKVDIEQSAQEFILRMTNKCTYLYGEDVLPKNSLLYSEYEVLNELNNLSLNGERLNVEDKKDIIEKIFKQKNKVKIKDIVNYYCSLGKEVSADDFSGLADMKEFKSSLKSYRDFDKILGDRFNYNFVEEAILAVLLFSGDKKILTSRLKKIGSGYFTDDEIKKISSLRYSDWGRFSKKLLTGIYSVYSQTGEYMNIITAMRETTCNFMETQGQNFGFKDEIQKINSEVMPKINDFSYDALVKDLYVSPKIKRSVWQTLLIVREIVKITGHEPKKIFIEMARGSDGTSKTPDSRKNRLLELYKKCGEDSGVLYDSLSKHTDSDLRKTALYLYYTQMGKCMYSGEDIELDDLFNKNIYDIDHIYPQSKTKDDSLDNKVLVKKKLNLDKSDKFPIPSHIITDKARENWIACKNAGLISKEKYERLTRKTELTADELAGFINRQLVETRQSTKAVAGIFTEMFPDTLIVYAKASNADVFKKHFDIPKVREVNDYHHARDAYVNIVVGNVFDVKFTRNAVRFIKSGKQYSLNECMYNYPVGNKDNPAWIPGDDGTIATVKKTCSKENILYTRMPYTQGGTLYDVQLLKKGKGQFPAKPGDCHFDGQTNEEIINKYGGYNKIKGAYFCLVEHMDKKNKRVRSIEYVPVYLADSIEKNPSLLEKYVSETLGLKDADVRIRRIKMDSLFSYNGFLMNLSGRTGDRLLFKSAVQLKLNSGDYKYLKIL

SEQ ID NO: 8505 - protein, 1346 aa, unidentified
  REGION 1..1346: note = Description of Unknown:uncultivated organism sequence
MNKQEYFLGLDLGTGSVGWCVTDTDYQILKKNRKPAIGSVLFSTAETAKGRRTVRCARRRLRRQQERIRCLQELFAEEMGKVDEGFFHRLAESPYVREDKRNADGTMPTLPYALFVDQDYTDKEYHRQYPTIYHLRKELMDHVSAHDIRLVYLAVAHILKHRGHFLSNIDVNGQGESFEELMLQFLNTWNSFFDLEIFLQTDEMENLKAVLLDPGITKTEKKAQIVALMQTKEKQVKELAALLVGASVSLDKLFDQEAYKNLEESKLQFDSASYEEKEGYYQEALGDSFELIARAKAVYNWCALSRILKNNPHGRISDAKVADYEKHKKDLQLLKKVLKEKFPPEVRKKILNESQKGLANYPAYIGMTRHNGRKEVIEGHCSREDFYKLLDKEVLKNLKDCEEKAYIQQQITLGQFLPKQKGSDNSVIPYQIHEKELKQILKNAEEYLPFLKEKDESGFTVSEKILQLLTFRIPFYVGPLNNAHQKEGYAWVVRREKGKVYPWNFEQKVDLEKSAEEFILRATNKCTYLKKEEVLPAGSLLFEKYKVLNELNTVKIQGVRLTVSIKQKVYEDLFCHHQRVTRKRLVQYLKKEGYYEDIGPEDISGIDQDFQSSMRSLLAFKQIHFDTHVSDSVMEDMIRDITLFGADQKLLKKRLLTKYPAYEKQIPAIVKTVKCDGWAPFSRKLLEGLAVETKEGEPIGTILYYLWNEQLNFNEILFQPQYGFQRLIQQENDDLTEKTDGIRYELVENLYVSPSVRRQIWMALKVIDEVQSFMGRAPKRVFVEMAREKQESKRTSDRKSQILQLYAYTKVNKELLEELKGCTNEELRKDKLFFYFMQMGRSAYTGDPIPFSALSDNSLYDIDHIYPRSLTADDSLDNRVLVEAKYNREKKQDKYPIDKKDRDRMAGIWRMWHEKKYISDEKYYRLTRATELTQDELCGFVNRQLVETRQSTKALTELLHQLMPDKTEIVYVKARHVVNFRHRFDLLKVRDLNDFHHGQDAYLNIVVGNIFHLKFTKDVRKYFQEKGTHRTYNLYKMFDYDVEFQGEKAWVSGQTIHTVKTMMENSKVMTVRQTYEEKGELYDLQRMKRGKGQVPLKESGRISDIEKYGGYNKATNTYFMLVKAEDKKGKSGTWLLPVPLYLKNRIEDYNEYAKEYFEQEYQLKQVEILRKVKMQTLFIYQGFKMRLAGRSGSQLVFHNANQLILPRKYHQTIRQISKHMLELQKDKRALLPDNQLLKESDMDELYLELCRKLKDSIYQVMLGRFLDTYESGYRRYQELSIEKKAEALYQMLKLFQCTPEMPNLTLIGGNAKPGPIRIGMNVTDRSSLAIVHQSVTGIYEQIERII

SEQ ID NO: 8506 - protein, 1346 aa, unidentified
  REGION 1..1346: note = Description of Unknown:uncultivated organism sequence
MNKQEYFLGLDLGTGSVGWCVTDTDYQILKKNRKPAIGSVLFSTAETAKGRRTVRCARRRLRRQQERIRCLQELFAEEMGKVDEGFFHRLAESPYVREDKRNADGTMPTLPYALFVDQDYTDKEYHRQYPTIYHLRKELMDHVSAHDIRLVYLAVAHILKHRGHFLSNIDVNGQGESFEELMLQFLNTWNSFFDLEIFLQTDEMENLKAVLLDPGITKTEKKAQIVALMQTKEKQVKELAALLVGASVSLDKLFDQEAYKNLEESKLQFDSASYEEKEGYYQEALGDFFELIARAKAVYNWCALSRILKNNPHGRISDAKVADYEKHKKDLQLLKKVLKEKFPPEVRKKILNESQKGLANYPAYIGMTRHNGRKEVIEGHCSREDFYKLLDKEVLKNLKDCEEKAYIQQQITLGQFLPKQKGSDNSVIPYQIHEKELKQILKNAEEYLPFLKEKDESGFTVSEKILQFLTFRIPFYVGPLNNAHQKEGYAWVVRREKGKVYPWNFEQKVDLEKSAAEFILRATNKCTYLKKEEVLPAGSLLFEKYKVLNELNTVKIQGVRLTVSIKQKVYEDLFCHHQRVTRKRLVQYLKKEGYYEDIGPEDISGIDQDFQSSMRSLLAFKQIHFDTHVSDSVMEDMIRDITLFGADQKLLKKRLLTKYPAYEKQIPAIVKTVKCDGWAPFSRKLLEGLAVETKEGEPIGTILYYLWNEQLNFNEILFQPQYGFQRLIQQENDDLTEKTDGIRYELVENLYVSPSVRRQIWMALKVIDEVQSFMGGAPKRVFVEMAREKQESKRTSDRKSQILQLYAYTKVNKELLEELKGCTNEELRKDKLFFYFMQMGRSAYTGDPIPFSALSDNSLYDIDHIYPRSLTADDSLDNRVLVEAKYNREKKQDKYPIDKKDRDRMAGIWRMWHEKKYISDEKYYRLTRATELTQDELCGFVNRQLVETRQSTKALTELLHQLMPDKTEIVYVKARHVVNFRHRFDLLKVRDLNDFHHGQDAYLNIVVGNIFHLKFTKDVRKYFQEKGTHRTYNLYKMFDYDVEFQGEKAWVSGQTIHTVKTMIASSKVLTARQTYEEKGELYDLQRMKKGKGQVPLKESGRISDIEKYGGYNKATNTYFMLVKAEDKKGKSGTWLLPVPLYLKNRIEDSNEYAKEYFEQEYQLKQVEILRKVKMQTLFIYQGFKMRLAGRSGSQLVFHNANQLILPRKYHQTIRQISKHMLELQKDKRALLPDNQLLKESDMDELYLELCRKLKDSIYQVMLGRFLDTYESGYRRYQELSIEKKAEALYQMLKLFQCTPEMPNLTLIGGNAKPGPIRIGMNVTDRSSLAIVHQSVTGIYEQIERII

SEQ ID NO: 8507 - protein, 1346 aa, unidentified
  REGION 1..1346: note = Description of Unknown:uncultivated organism sequence
MNKQEYFLGLDLGTGSVGWCVTDTDYQILKKNRKPAIGSVLFSTAETAKGRRTVRCARRRLRRQQERIRCLQELFAEEMGKVDDGFFHRLAESPYVREDKRNADGTMPTLPYALFVDQDYTDKEYHRQYPTIYHLRKELMDHVSAHDIRLVYLAVAHILKHRGHFLSNIDVNGQGESFEELMLQFLNTWNSFFDLEIFLQTDEMENLKAVLLDPGITKTEKKAQIVALMQTKEKQVKELAALLVGASVSLDKLFDQEAYKNLEESKLQFDSASYEEKEGYYQEALGDFFELIARAKAVYNWCALSRILKNNPHGRISDAKVADYEKHKKDLQLLKKVLKEKFPPEVRKKILNESQKGLANYPAYIGMTRHNGRKEVIEGHCSREDFYKLLDKEVLKNLKDCEEKAYIQQQITLGQFLPKQKGSDNSVIPYQIHEKELKQILKNAEEYLPFLKEKDESGFTVSEKILQLLTFRISFYVGPLNNAHQKEGYAWVVRREKGKVYPWNFEQKVDLEKSAEEFILRATNKCTYLKKEEVLPAGSLLFEKYKVLNELNTVKIQGVRLTVSIKQKVYEDLFCHHQRVTRKRLVQYLKKEGYYEDIGPEDISGIDQDFQSSMRSLLAFKQIHFDTHVSDSVMEDMIRDITLFGADQKLLKKRLLTKYPSYKKQIPAIVKTVKCDGWAPFSRKLLEGLAVETKEGEPIGTILYYLWNEQLNFNEILFQPQYGFQRLIQQENDDLTEKTDGIRYELVENLYVSPSVRRQIWMALKVIDEVQSFMGGAPKRVFVEMAREKQESKRTSDRKSQILQLYAHTKVNKELLEELKGCTNEELRKDKLFFYFMQMGRSAYTGDPIPFSALSDNSLYDIDHIYPRSLTADDSLDNRVLVEAKYNREKKQDKYPIDKKDRDRMAGIWRMWHEKKYISDEKYYRLTRATELTQDELCGFVNRQLVETRQSTKALTELLHQLMPDKTEIVYVKARHVVNFRHRFDLLKVRDLNDFHHGQDAYLNIVVGNIFHLKFTKDVRKYFQEKGTHRTYNLYKMFDYDVEFQGEKAWVSGQTIHTVKTMIASSKVLTARQTYEEKGELYDLQRMKKGKGQVPLKESGRISDIEKYGGYNKATNTYFMLVKAEDKKGKSGTWLLPVPLYLKNRIEDYNEYAKEYFEQEYQLKQVEILRKVKMQTLFIYQGFKMRLAGRSGSQLVFHNANQLILPRKYHQTIRQISKHMLELQKDKRALLPDNQLLKESDMDELYLELCRKLKDSIYQVMLGRFLDTYESGYRRYQELSIEKKAEALYQMLKLFQCTPEMPNLTLIGGNAKPGPIRIGMNVTDRSSLAIVHQSVTGIYEQIERII

SEQ ID NO: 8508 - protein, 1346 aa, unidentified
  REGION 1..1346: note = Description of Unknown:uncultivated organism sequence
MNKQEYFLGLDLGTGSVGWCVTDTDYQILKKNRKPAIGSVLFSTAETAKGRRTVRCARRRLRRQQERIRCLQELFAEEMGKVDEGFFHRLAESPYVREDKRNADGTMPTLPYALFVDQDYTDKEYHRQYPTIYHLRKELMDHVSAHDIRLVYLAVAHILKHRGHFLSNIDVNGQGESFEELMLQFLNTWNSFFDLEIFLQTDEMENLKAVLLDPGITKTEKKAQIVALMQTKEKQVKELAALLVGASVSLDKLFDQEAYKNLEESKLQFDSASYEEKEGYYQEALGDFFELIARAKAVYNWCALSRILKNNPHGRISDAKVADYEKHKKDLQLLKKVLKEKFPPEVRKKILNESQKGLANYPAYIGMTRHNGRKEVIEGHCSREDFYKLLDKEVLKNLEDCEEKAYIQQQITLGQFLPKQKGSDNSVIPYQIHEKELKQILKNAEEYLPFLKEKDESGFTVSEKILQLLTFRISFYVGPLNNAHQKEGYAWVVRREKGKVYPWNFEQKVDLEKSAEEFILRATNKCTYLKKEEVLPAGSLLFEKYKVLNELNTVKIQGVRLTVSIKQKVYEDLFCHHQRVTRKRLVQYLKKEGYYEDIGPEDISGIDQDFQSSMRSLLAFKQIHFDTHVSDSVMEDMIRDITLFGADQKLLKKRLLTKYPAYEKQIPAIVKTVKCDGWAPFSRKLLEGLAVETKEGEPIGTILYYLWNEQLNFNEILFQPQYGFQRLIQQENDDLTEKTDGIRYELVENLYVSPSVRRQIWMALKVIDEVQSFMGRAPKRVFVEMAREKQESKRTSDRKSQILQLYAHTKVNKELLEELKGCTNEELRKDKLFFYFMQMGRSAYTGDPIPFSVLSDNSLYDIDHIYPRSLTADDSLDNRVLVEAKYNREKKQDKYPIDKKDRDRMAGIWRMWHEKKYISDEKYYRLTRATELTQDELCGFVNRQLVETRQSTKALTELLHQLMPDKTEIVYVKARHVVNFRHRFDLLKVRDLNDFHHGQDAYLNIVVGNIFHLKFTKDVRKYFQEKGTHRTYNLYKMFDYDVEFQGEKAWVSGQTIHTVKTMIASSKVLTARQTYEEKGELYDLQRMKKGKGQVPLKESGRISDIEKYGGYNKATNTYFMLVKAEDKKGKSGTWLLPVPLYLKNRIEDYNEYAKEYFEQEYQLKQVEILRKVKMQTLFIYQGFKMRLAGRSGSQLVFHNANQLILPRKYHQTIRQISKHMLELQKDKRALLPDNQLLKESDMDELYLELCRKLKDSIYQVMLGRFLDTYESGYRRYQELSIEKKAEALYQMLKLFQCTPEMPNLTLIGGNAKPGPIRIGMNVTDRSSLAIVHQSVTGIYEQIERII

SEQ ID NO: 8509 - protein, 1347 aa, unidentified
  REGION 1..1347: note = Description of Unknown:uncultivated organism sequence
MKKQDYFLGLDLGTGSVGWCVTDMEYHILKENRKPAIGSVLFSTAETAKGRRIVRCARRRLKRQQERIRCLQELFAEEIRKVDAGFFHRLSESPYVKADKQNEDGSKPELPYALFVDPDYTDKEYHQQYPTIYHLRKELMDNASVHDIRLVYLAAAHILKHRGHFLSNIDVNGRGVSFEELIGQLLNTWNSIFDQGLSLQAEELENLKEILQDSGITKTEKKTQIIALLKTKEKQMKELAALLTGSSVSLDKLFGREEYKNLEENKLQFDAASYEEKEGYYQEVLGDSFELITNARAVYNWCALSRILKNNPQGRISDAKVADYEKHKKDLQILKKILRENCPEDIQKKILSVSQKGLANYPAYIGMTKHNGKKMVIEDRCSKEDFYKLLEKEILADMEDCEEKTYICQQIALGQFLPKQKGSDNSVIPYQIHEKELKRILKNAEGYLPFLKKKDASGFTVSEKILQLLTFRIPFYVGPLNNTYQKNSYAWVARREKGKIYPWNFEQKVDLEKSAEEFILRMTNKCTYLRKEDVLPAGSLLFEKYKVLNELNTVKIRGERLPVPVKQKVYEDLFCHHQRITRKRLGQYLKKEGYYEDIGPENISGLDQDFQASLKSMLAFKQIHFDSPVPEWIIEDIIRDITLFGADPKLLKNRLSVKYPSYEKQIPVIVKNVKCDGWAPFSRKLLEGLAVETDEGEPVGTIMYYLWNGQQNFNEILYQPRYGFQKLIEQENQDITGKSDSIRYELVEDLYVSPAVRRQIWMALKVIDEVQGFMGQPPKRIFVEMAREKQESKRTSDRKSQILELYAHTKVDADLLDELKGCTNEELRRDKLFFYFTQMGRSAYTGKRIPFSALSDNSLYDIDHIYPRSLTADDSLDNRVLVEARLNREEKQDKYPIEKKYRDKMAGDWKIWHERKYISDEKYRRLTRTTELTHDELCSFVNRQLVETRQSTKALTELLHRLMPKDSTEIVYVKAKHVVDFRHKFDLLKVRDLNDFHHAQDAYLNIVVGNVFHLKFTKDVRKYFAEKGSYRTYNLYRMFENDVEYQGERAWDKEETIRTVKEMMANSRILTARQTYEEKGELYNLQRMKKGKGQVPLKEGGRIADIEKYGGYNKATNTYFMLTRAEDKKGRSSVWILPVPLYRKNKIESSREYAKAYFEQEYQLNQVEILRKIKMQTLFVYQGFKMRLAGRSGSQLVFHNANQLMLPREYHQTIRQISKHMLELQKDKRALLPDNQLLKEEDMDKLYLELCRKLQESIYRVMLGRFSDTYESGYKRYQELSREKKAEALYQMLKLFQCTPELPNLTLIGGTGTQGAIRIGMNVTDRKSLAIIHQSVTGIYEQIERIV

SEQ ID NO: 8510 - protein, 1351 aa, unidentified
  REGION 1..1351: note = Description of Unknown:uncultivated organism sequence
MKKHQDYFLGLDLGTGSVGWCVTDTEYRILKANRKRTIGTVLFSTAETAKERRTLRCARRRLRRQKERLLCLQELFREEIEKVDPGFFFRLQESPYAVEEKQNPDGSRAELPYALFVDKDYTDKEFHAQYPTIYHLRKELMDNPLPHDARLVYLAAAHIIKHRGHFLSSISAEGKEASFEELLSQFTQLWNEYMDHTLTLSEGEKGKLKETLLDAGMTKSGKKTAIIRLLGTKEPQPKEMAALLTGASASIEKLFDKEEYKNLEENKIQFDAPSYEEKEEYYREALGDDFEIVARARAIYNWCALSKILKNNPGGRISDARVEDYERHRTDLQLLKKLLSENFPKETQERILKVSEKGLANYPAYIGMTKKNGKKVPVVERCSKEDFYKLLDKEILKNLGDSEEKAYMEQQIRLGGFLPKQKGNGNSVVPYQLHEKELKLILKNAEGYLPFLKEKDESGYTVSEKILQLLTFRIPYYVGPLYGGGGGHSYAWVKRLEDGKVYPWNFEQKIDVEKSAEEFIRRAVSTCSWLKNEKVLPAGSLLFEKFKVLNELNNVRIYGERLEVDIKQRIYQELFCRHLRITKKRLIQYLKKEGIYAKVEPEDISGLDENFQSSLKSLLAFKQIHFDSPVPEQAMEDMIKDITLFGEDPKLLKKRLLVKYPEYGKQIPAIIKTVKCDGWASLSEKLLTGLAVDIPGEGPVGTILYFLWNTRQNLMEILYNPEYAFQDLIKTENGDTGRKDGKISYELVEELYVSPSVKRQIWMALKVIEEVRHFMGCEPKRIFVEMAREKQESKRTSDRKAQIMQLYSAIRTDKDYKELLKELNGCSNDELRKDKLFLYFMQMGRCAYTGKRIPFSDLKYDSLYDIDHIYPRSQTADDSLDNRVLVDAEYNREEKQDLYPIKKETRDEREALWRFWREKKFISDEKYRRLTRATKLTNEELIGFVNRQLVETRQSTKALAEVLNQTKTEQTEVVYVKAKNVTEFRHRYKLLKVRVLNDFHHAQDAYLNIVVGNVYHLKFTKDVRRYFLDKGTYRTYNLTKMFDETVKCGEETAWNKGVSIGTVKEMMKNEKILVSRQTYEEKGKLYDVQRLKKGQGQVPVKESGRMSDISRYGGYGSAKNTYFMLVEAEDKKKKESLWILPVPLYLKQKIESSEEYARSYFEQEYSLCHVRVLKKIRIQTLFVYEGFRMRLAGRSGSQLVFHNANELCLPARHHNTIRQISKHIQELQYDMDAAISDNGLLTEQDLDALYIELCEKLKGSVYQTMLGGYIEKYESGYEKYQKLTLEKKAQALWQMLKIFQCTPEMPDLTLIGGSKSQGAIRMGMNVTGRKSLALIHQSVTGIYERVEKIRG

SEQ ID NO: 8511 - protein, 788 aa, unidentified
  REGION 1..788: note = Description of Unknown:uncultivated organism sequence
MCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKIIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8512 - protein, 1360 aa, unidentified
  REGION 1..1360: note = Description of Unknown:uncultivated organism sequence
MKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIMGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKIIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8513 - protein, 1346 aa, unidentified
  REGION 1..1346: note = Description of Unknown:uncultivated organism sequence
MNKQEYFLGLDLGTGSVGWCVTDTDYQILKRNRKPAIGSVLFSTADTAKGRRTVRCARRRLRRQQERIRCLQELFAEEIGEVDEGFFHRLAESPYVKEDKRNADGTTPTLPYALFVDLDYTDKDYHRQYPTIYHLRKELMDHVSAHDIRLVYLAVAHILKHRGHFLSNIDVNGQGESFEELMLQFLNTWNSFFDLEIFLQTDEMENLKAILLDPGITKTEKKAQIVALLQTKEKQVKELAALLVGASVSLDKLFDQEAYKNLEESKLQFDSASYEEKEGYYQEALGDSFELIARAKAVYNWCALSRILKNNPHGRISDAKVADYEKHKKDLQILKKVLKEKFPPEVRKKILNESQKGLANYPAYIGMTRHNGRKEVIEGHCSREDFYKLLDKEVLKNLEDCEEKAYIQQQITLGQFLPKQKGSDNSVIPYQIHEKELKQILKNAEEYLPFLKEKDESGFTVSEKILQLLTFRIPFYVGPLNNAHQKEGYAWVVRREKGKVYPWNFEQKVDLEKSAEEFILRATNKCTYLKKEEVLPAGSLLFEKYKVLNELNTVKIQGVRLTVSIKQKVYEDLFCHHQRVTRKRLVQYLKKEGYYKDIGPEDISGIDQDFQSSMRSLLAFKQIHFDTPISDSVMEDMIRDITLFGADQKLLKKRLLTKYPAYEKQIPAIVKTVKCDGWAPFSRKLLEGLAVETKEGEPIGTILYYLWNEQLNFNEILFQPQYGFQRLIQQENDDLTEKTAGIRYELVENLYVSPSVRRQIWMALKVIDEVQSFMGGAPKRVFVEMAREKQESKRTSDRKSQILQLYAHTKVNKELLEELKGCTNEELRKDKLFFYFMQMGRSAYTGDPIPFSVLSDNSLYDIDHIYPRSLTADDSLDNRVLVEAKYNREKKQDKYPIDKKVRDRMAGIWRMWHEKKYISDEKYYRLTRATELTQDELCGFVNRQLVETRQSTKALTELLHQLMPDKTEIVYVKARHVVNFRHRFDLLKVRDLNDFHHGQDAYLNIVVGNIFHLKFTKDVRKYFQEKGTHRTYNLYKMFDYDVEFQGEKAWVSGQTIHTVKTMMANSKVLTARQTYEEKGELYDLQRMKKGKGQVPLKESGRISDIEKYGGYNKATNTYFMLFKAEDKKGKSGTWLLPVPLYLKNRIEDSNEYAKEYFEQEYQLKQVEILRKVKMQTLFIYQGFKMRLAGRSGSQLVFHNANQLILPRKYHQTIRQISKHMLELQKDKRALLPDNQLLKESDMDELYLELCRKLKDSIYQVMLGRFLDTYESGYRRYQELSIEKKAEALYQMLKLFQCTPEMPNLTLIGGNAKPGSIRIGMNVTDRSSLAIVHQSVTGIYEQIERII

SEQ ID NO: 8514 - protein, 1346 aa, unidentified
  REGION 1..1346: note = Description of Unknown:uncultivated organism sequence
MNKQEYFLGLDLGTGSVGWCVTDTDYQILKKNRKPAIGSVLFSTAETAKGRRTVRCARRRLRRQQERIRCLQELFAEEMGKVDEGFFHRLAESPYVREDKRNADGTMPTLPYALFVDQDYTDKEYHRQYPTIYHLRKELMDHVSAHDIRLVYLAVAHILKHRGHFLSNIDVNGQGESFEELMLQFLNTWNSFFDLEIFLQTDEMENLKAILLDPGITKTEKKAQIVALLQTKEKQVKELAALLVGASVSLDKLFDQEAYKNLEESKLQFDSASYEEKEGYYQEALGDSFELIARAKAVYNWCALSRILKNNPHGRISDAKVADYEKHKKDLQLLKKVLKEKFPPEVRKKILNESQKGLANYPAYIGMTRHNGRKEVIEGHCSREDFYKLLDKEVLKNLEDCEEKAYIQQQITLGQFLPKQKGSDNSVIPYQIHEKELKQILKNAEEYLPFLKEKDESGFTVSEKILQLLTFRIPFYVGPLNNAHQKEGYAWVVRREKGKVYPWNFEQKVDLEKSAEEFILRATNKCTYLKKEEVLPAGSLLFEKYKVLNELNTVKIQGVRLTVSIKQKVYEDLFCHHQRVTRKRLVQYLKKEGYYEDIGPEDISGIDQDFQSSMRSLLAFKQIHFDTHVSDSVMEDMIRDITLFGADQKLLKKRLLTKYPAYEKQIPAIVKTVKCDGWAPFSRKLLEGLAVETKEGEPIGTILYYLWNEQLNFNEILFQPQYGFQRLIQQENDDLTERTDGIRYELVENLYASPSVRRQIWMALKVIDEVQSFMGGAPKRVFVEMAREKQESKRTSDRKSQILQLYAHTKVNKELLEELKGCTNEELRKDKLFFYFMQMGRSAYTGDPIPFSVLSDNSLYDIDHIYPRSLTADDSLDNRVLVEAKYNREKKQDKYPIDKKVRDRMAGIWRMWHEKKYISDEKYYRLTRATELTQDELCGFVNRQLVETRQSTKALTELLHQLMPDKTEIVYVKARHVVNFRHRFDLLKVRDLNDFHHGQDAYLNIVVGNIFHLKFTKDVRKYFQEKGTHRTYNLYKMFDYDVEFQGEKAWVSGQTIHTVKTMIASSKVLTVRQTYEEKGELYDLQRMKKGKGQVPLKESGRISDIEKYGGYNKATNTYFMLVKAEDKKGKSGTWLLPVPLYLKNRIEDSNEYAKEYFEQEYQLKQVEILRKVKMQTLFIYQGFKMRLAGRSGSQLVFHNANQLILPRKYHQTIRQISKHMLELQKDKRALLPDNQLLKESDMDELYLELCRKLKDSIYQVMLGRFLDTYESGYRRYQELSIEKKAEALYQMLKLFQCTPEMPNLTLIGGNAKPGPIRIGMNVTDRSSLAIVHQSVTGIYEQIERII

SEQ ID NO: 8515 - protein, 1350 aa, unidentified
  REGION 1..1350: note = Description of Unknown:uncultivated organism sequence
MSKPGEYYLGLDLGTGSVGWCVTDTEYRIPKVNRRRTIGTVLFSTAETAKERRVIRCARRRLRRQRERLDCLQEMFGEEIAKIDAGFFHRLLESPYIPEDKENLDGSRPELPYALFVDKDFSDVQYHVKYPTIYHLRKELMDDPSPHDLRLVYLAVAHILKHRGHFLSSFDVNENGRSFEEILDDFIKVWNEYTEKNIELSSDSRVILKEILLDSSRLKSQKKTEIIRILGGRNPQFKELAALFVGASTSLEKLFCKEEYKNLEENKIQFDAADYEEKEGYYRESLGDDFEVIERAREIYNWYALSKILKNNPGGRISDAKVEDYRQHKTDLALLKKVLKEHFPKELRYRILNASEKGLANYPAYIGMTKHDGRKKSIAERCTKEDFYKLLEKEVINSLEDCDEKKYIEQQIRLGEFLPRQKGSGNSVIPYQLHLKELQLILKNAEGYLPFLKEKDESGLSVSEKIIQLMTFRIPYYVGPLHTGGKNAYAWVQRLESGKVYPWNFEQKIDVEKTAEEFIQRAVNKCTYLKNEKVLPMCSLLFEKYKVLNELNSVRIFGERLTVADKQKIYQDLFCHHMRVTRKRLIQYLKKEGICVKVEAEDISGIDGDFKSSLKTMLAFKQIHFEKPLSEQIMEDMVRDITLFGADTSLLKKRLLAKYPAYEKQIPMIIKNVKCDGWASLSGKLLEGLAVEIPGLGNVGNIIYLLWNTQQNFMEILYNPEYMFQEMIKKENGATEGKDRKIDYAMVDELYVSPSVKRQIWMALQVIKEVQHFMGGAPKRVFVEMAREKQESKRTSDRKTQIMQLYNAIGSDRVSRELMEELEGCSNDQLRKDKLFFYFTQMGCSAYTGKPISFSDLKDDNLYDIDHIYPRSQTADDSLNNRVLVEAKLNREEKKDNYPLTEKIRADMERLWRFWHEKKLISDEKYHRLTRTTELTNDELLGFVSRQLVETRQSTKALTELLGQIMPDQTEIVYVKAGNVSRFRQQYDLLKVRELNNFHHVQDAYLNIVVGNVYHLKFTKDIRKYFMEKGTYRTYNLTKMFNYTVKYRDETAWEENRTIRTVKEMMKNEKILVSRQTYEEKGELYKVQRLKKGKGQVPVKETGRLSDISKYGGYDKARNTYFMLVKAENKKGRECTCILPVPLYLKQKMEDSEIFMKKYFEQEYQLTHVRLEEKIKIQTLFVYQGFRMRLAGRSGSQIVFHNANELCFPAACQKTIRQIGKHMKELSYDKNARISDNGLLTQDDLDELYRVLCEKLENTVYKIMLHGYIEKYRSGFELYEKLSLEKRAEALWQMLKIFQCTPEMPDLTLIGGSKNQGAIRMGMDISGRESLAIIHQSVTGIYEQIEKIRG

SEQ ID NO: 8516 - protein, 1346 aa, unidentified
  REGION 1..1346: note = Description of Unknown:uncultivated organism sequence
MNKQEYFLGLDLGTGSVGWCVTDTDYQILKKNRKPAIGSVLFSTAETAKGRRTVRCARRRLRRQQERIRCLQELFAEEMGKVDEGFFHRLAESPYVREDKRNADGTMPTLPYALFVDQDYTDKEYHRQYPTIYHLRKELMDHVSAHDIRLVYLAVAHILKHRGHFLSNIDVNGQGESFEELMLQFLNTWNSFFDLEIFLQTDEMENLKAVLLDPGITKTEKKAQIVALMQTKEKQVKELAALLVGASVSLDKLFDQEAYKNLEESKLQFDSASYEEKEGYYQEALGDFFELIARAKAVYNWCALSRILKNNPHGRISDAKVADYEKHKKDLQLLKKVLKEKFPPEVRKKILNESQKGLANYPAYIGMTRHNGRKEVIEGHCSREDFYKLLDKEVLKNLKDCEEKAYIQQQITLGQFLPKQKGSDNSVIPYQIHEKELKQILKNAEEYLPFLKEKDESGFTVSEKILQLLTFRIPFYVGPLNNAHQKEGYAWVVRREKGKVYPWNFEQKVDLEKSAEEFILRATNKCTYLKKEEVLPAGSLLFEKYKVLNELNTVKIQGVRLTVSIKQKVYEDLFCHHQRVTRKRLVQYLKKEGYYEDIGPEDISGIDQDFQSSMRSLLAFKQIHFDTHVSDSVMEDMIRDITLFGADQKLLKKRLLTKYPAYEKQIPAIVKTVKCDRWAPFSRKLLEGLAVETKEGEPIGTILYYLWNEQLNFNEILFQPQYGFQRLIQQENDDLTEKTDGIRYELVENLYVSPSVRRQIWMALKVIDEVQSFMGGAPKRVFVEMAREKQESKRTSDRKSQILQLYAYTKVNKELLEELKGCSNEELRKDKLFFYFMQMGRSAYTGDPIPFSALSDNSLYDIDHIYPRSLTADDSLDNRVLVEAKYNREKKQDKYPIDKKDRDRMAGIWRMWHEKKYISDEKYYRLTRATELTQDELCGFVNRQLVETRQSTKALTELLHQLMPDKTEIVYVKARHVVNFRHRFDLLKVRDLNDFHHGQDAYLNIVVGNIFHLKFTKDMRKYFQEKGTHRTYNLYKMFDYDVEFQGEKAWVSGQTIHTVKTMIASSKVLTARQTYEEKGELYDLQRMKKGKGQVPLKESGRISDIEKYGGYNKATNTYFMLVKAEDKKGKSGTWLLPVPLYLKNRIEDYNEYAKEYFEQEYQLKQVEILRKVKMQTLFIYQGFKMRLAGRSGSQLVFHNANQLILPRKYHQTIRQISKHMLELQKDKRALLPDNQLLKESDMDELYLELCRKLKDSIYQVMLGRFLDTYESGYRRYQELSIEKKAEALYQMLKLFQCTPEMPNLTLIGGNAKPGPIRIGMNVTDRSSLAIVHQSVTGIYEQIERII

SEQ ID NO: 8517 - protein, 1350 aa, unidentified
  REGION 1..1350: note = Description of Unknown:uncultivated organism sequence
MSKPGEYYLGLDLGTGSVGWCVTDTEYRIPKVNRRRTIGTVLFSTAETAKERRVIRCARRRLRRQRERLDCLQEMFGEEIAKIDAGFFHRLLESPYIPEDKENLDGSRPELPYALFVDKDFSDVQYHVKYPTIYHLRKELMDDPSPHDLRLVYLAVAHILKHRGHFLSSFDVNENGRSFEEILDDFIKVWNEYTEKNIELSSDSRVILKEILLDSSRLKSQKKTEIIRILGGRNPQFKELAALFVGASTSLEKLFCKEEYKNLEENKIQFDAADYEEKEGYYRESLGDDFEVIERAREIYNWYALSKILKNNPGGRISDAKVEDYRQHKTDLALLKKVLKEHFPKELRYRILNASEKGLANYPAYIGMTKHDGRKKSIAERCTKEDFYKLLEKEVINSLEDCDEKKYIEQQIRLGEFLPRQKGSGNSVIPYQLHLKELQLILKNAEGYLPFLKEKDESGLSVSEKIIQLMTFRIPYYVGPLHTGGKNAYAWVQRLESGKVYPWNFEQKIDVEKTAEEFIQRAVNKCTYLKNEKVLPMCSLLFEKYKVLNELNSVRIFGERLTVADKQKIYQDLFCHHMRVTRKRLIQYLKKEGICVKVEAEDISGIDGDFKSSLKTMLAFKQIHFEKPLSEQIMEDMVRDITLFGADTSLLKKRLLAKYPAYEKQIPMIIKNVKCDGWASLSGKLLEGLAVEIPGLGNVGNIIYLLWNTQQNFMEILYNPEYMFQEMIKKENGATEGKDRKIDYAMVDELYVSPSVKRQIWMALQVIKEVQHFMGGAPKRVFVEMAREKQESKRTSDRKTQIMQLYNAIGSDRVSRELMEELEGCSNDQLRKDKLFFYFTQMGCSAYTGKPISFSDLKDDNLYDIDHIYPRSQTADDSLNNRVLVEAKLNREEKKDNYPLTEKIRADMERLWRFWHEKKLISDEKYHRLTRTTELTNDELLGFVSRQLVETRQSTKALTELLGQIMPDQTEIVYVKAGNVSRFRQQYDLLKVRELNNFHHAQDAYLNIVVGNVYHLKFTKDIRKYFMEKGTYRTYNLTKMFNYTVKYRDETAWEENRTIRTVKEMMKNEKILVSRQTYEEKGELYKVQRLKKGKGQVPVKETGRLSDISKYGGYDKARNTYFMLVKAENKKGRECTCILPVPLYLKQKMEDSEIFMKKYFEQEYQLTHVRLEEKIKIQTLFVYQGFRMRLAGRSGSQIVFHNANELCFPAACQKTIRQIGKHMKELSYDKNARISDNGLLTQDDLDELYRVLCEKLENTVYKIMLHGYIEKYRSGFELYEKLSLEKRAEALWQMLKIFQCTPEMPDLTLIGGSKNQGAIRMGMDISGRESLAIIHQSVTGIYEQIEKIRG

SEQ ID NO: 8518 - protein, 814 aa, unidentified
  REGION 1..814: note = Description of Unknown:uncultivated organism sequence
MCSLLFEKYKVLNELNSVRIFGERLTVADKQKIYQDLFCHHMRVTRKRLIQYLKKEGICVKVEAEDISGIDGDFKSSLKTMLAFKQIHFEKPLSEQIMEDMVRDITLFGADTSLLKKRLLAKYPAYEKQIPMIIKNVKCDGWASLSGKLLEGLAVEIPGLGNVGNIIYLLWNTQQNFMEILYNPEYMFQEMIKKENGATEGKDRKIDYAMVDELYVSPSVKRQIWMALQVIKEVQHFMGGAPKRVFVEMAREKQESKRTSDRKTQIMQLYNAIGSDRVSRELMEELEGCSNDQLRKDKLFFYFTQMGCSAYTGKPISFSDLKDDNLYDIDHIYPRSQTADDSLNNRVLVEAKLNREEKKDNYPLTEKIRADMERLWRFWHEKKLISDEKYHRLTRTTELTNDELLGFVSRQLVETRQSTKALTELLGQIMPDQTEIVYVKAGNVSRFRQQYDLLKVRELNNFHHAQDAYLNIVVGNVYHLKFTKDIRKYFMEKGTYRTYNLTKMFNYTVKYRDETAWEENRTIRTVKEMMKNEKILVSRQTYEEKGELYKVQRLKKGKGQVPVKETGRLSDISKYGGYDKARNTYFMLVKAENKKGRECTCILPVPLYLKQKMEDSEIFMKKYFEQEYQLTHVRLEEKIKIQTLFVYQGFRMRLAGRSGSQIVFHNANELCFPAACQKTIRQIGKHMKELSYDKNARISDNGLLTQDDLDELYRVLCEKLENTVYKIMLHGYIEKYRSGFELYEKLSLEKRAEALWQMLKIFQCTPEMPDLTLIGGSKNQGAIRMGMDISGRESLAIIHQSVTGIYEQIEKIRG

SEQ ID NO: 8519 - protein, 1399 aa, unidentified
  REGION 1..1399: note = Description of Unknown:uncultivated organism sequence
MNTAVSKDSRGSDYYLGLDIGTASVGWAVANTDYELVKEHRKYLWGVRLFDTADTAAERRLHRAARRRHQRRLQRQRLLKEIFEDKISEVDPHFFERLKESSYHREDRSGNFLSTLFNDESFKDTDYFAKFPTIFHLRSHLIHHPEERPDIRILYLAIHSILKHRGHFLFPGESLESISSFSLLFDELLKNIETSLQCTLHVSCTPETFGTILKKKRRTDKKNDLQEVLTLTRTTEEEIEETPKKLTSELIKALSGTPFLLSMLFENDSYKDSEQDKIEFDKEGFEDLKESIEVLLEPEEYALIEILEGIYNWTLLSDILNGEKFISDAKVASYRNHKDDLKQLKLLVKKYAGSAYYKAFKDPSIQNNYAHYIGTGNKSGKKVQVAHKGKCLQEDVNKYFHNLLKPYQNDEDRDLDNMLEKLEQKSALPKQRVRDNRVIPHQLHLKELQIILENAKAYYPFLTIPDDDGYTPTQKIISMMTFRIPYYVGPLNTSHMEKEGKEGFCWMVRQQGKEDVPIFPWNWTEVVDKNASAEKFITRMTNSCTYLFNEEVLPKFSLLYNRYMVLNELNNLKVNGEPISVELKQKIYNELFLHSGKKTITLKMLQKFLVVNNIVNKGDVTTIEGIDNGFANSLKSHIDFAPYLEANILSVEDVEKIIEWKAYYVDDATILKEKITQELHEKLTSEQIDDITKLVRNYKGWGRLSRAFLEDIYHVDRATGEGYSIIHMMWETNENLMELLSSKYDYLDEIQRINNETLINKKFSYESLVRPLSVSPPVKRQIWQTLLIVHELKKVMGKAPKRVFIEMAREEREKKRTTSRKESLRILYDRCKNDISFNKALLESLDTKTDTELRNDRLYFYYTQMGRCPYCGGKIELDQMNNTQLYDIDHIYPQSLIKDDSLKNRVLAHKACNGEKGNSYPINPQWQNTMIGFWKVLLDRSLISKEKYARLTRTTPLSDEELFAFINRQLVETRQSTKVVASILKNLFQDEGTEIVYVKARNVSSFRTDFEIKKSRLVNDHHHAHDAYLNIVVGNAYHTKFTGDARNFIKELKRGDQYYNASNIFSRSIQRNGRLAWIADERYDANKGRPKSEKQETGTIATIRKMLRNHQVLVTRQAVEVSGALFKLQPLRKKKNLLPLKGSSQTLQDTTKYGGYNAPATAYFALVQHEKKGKEVRQFVPVPILYAELFKQNPGTLLKYCEEELDLINAKIVIPQILLHELVQLKGYTMSLSGITGPQTVANNEIQLVLSDEDYDYVAQIEKYLSLLKKVKDPEVQENAEILAESLHICKQDNLTLYELLLAKERGSIYRYRPANQAKFLEEKRSIFESLDIKGQCEVLVQIINLFTCTPESANLTKLGGGSSSGIVKFQSQITDKEARLIHQSPTGIFTKSRRVYEI

SEQ ID NO: 8520 - protein, 1399 aa, unidentified
  REGION 1..1399: note = Description of Unknown:uncultivated organism sequence
MNTAVSKDSRGSDYYLGLDIGTASVGWAVANTDYELVKEHRKYLWGVRLFDTADTAAERRLHRAARRRHQRRLQRQRLLKEIFEDKISEVDPHFFERLKESSYHREDRSGNFLSTLFNDESFKDTDYFAKFPTIFHLRSHLIHHPEERPDIRILYLAIHSILKHRGHFLFPGESLESISSFSLLFDELLKNIETSLQCTLHVSCTPETFGTILKKKRRTDKKNDLQEVLTLTRTTEEEIEETPKKLTSELIKALSGTPFLLSMLFENDSYKDSEQDKIEFDKEGFEDLKESIEVLLEPEEYALIETLEGIYNWTLLSDILNGEKFISDAKVASYRNHKDDLKQLKLLVKKYAGSAYYKAFKDPSIQNNYAHYIGTGNKSGKKVQVAHKGKCLQEDVNKYFHNLLKPYQNDEDRDLDNMLEKLEQKSALPKQRVRDNRVIPHQLHLKELQIILENAKAYYPFLTIPDDDGYTPTQKIISMMTFRIPYYVGPLNTSHMEKEGKEGFCWMVRQQGKEDVPIFPWNWTEVVDKNASAEKFITRMTNSCTYLFNEEVLPKFSLLYNRYMVLNELNNLKVNGEPISVELKQKIYNELFLHSGKKTITLKMLQKFLVVNNIVNKGDVTTIEGIDNGFANSLKSHIDFAPYLEANILSVEDVEKIIEWKAYYVDDATILKEKITQELHEKLTSEQIDDITKLVRNYKGWGRLSRAFLEDIYHVDRATGEGYSIIHMMWETNENLMELLSSKYDYLDEIQRINNETLINKKFSYESLVRPLSVSPPVKRQIWQTLLIVHELKKVMGKAPKRVFIEMAREEREKKRTTSRKESLRILYDRCKNDISFNKALLESLDTKTDTELRNDRLYFYYTQMGRCPYCGGKIELDQMNNTQLYDIDHIYPQSLIKDDSLKNRVLAHKACNGEKGNSYPINPQWQNTMIGFWKVLLDRSLISKEKYARLTRTTPLSDEELFAFINRQLVETRQSTKVVASILKNLFQDEGTEIVYVKARNVSSFRTDFEIKKSRLVNDHHHAHDAYLNIVVGNAYHTKFTGDARNFIKELKRGDQYYNASNIFSRSIQRNGRLAWIADERYDANKGRPKSEKQETGTIATIRKMLRNHQVLVTRQAVEVSGALFKLQPLRKKKNLLPLKGSSQTLQDTTKYGGYNAPATAYFALVQHEKKGKEVRQFVPVPILYAELFKQNPGTLLKYCEEELDLINAKIVIPQILLHELVQLKGYTMSLSGITGPQTVANNEIQLVLSDEDYDYVAQIEKYLSLLKKVKDPEVQENAEILAESLHICKQDNLTLYELLLAKERGSIYRYRPANQAKFLEEKRSIFESLDIKGQCEVLVQIINLFTCTPESANLTKLGGGSSSGIVKFQSQITDKEARLIHQSPTGIFTKSRRVYEI

SEQ ID NO: 8521 - protein, 830 aa, unidentified
  REGION 1..830: note = Description of Unknown:uncultivated organism sequence
MLKEYDANIYKEFFNSGEKIKNNYSAYIGFYKKNGRKITVKKCTREDFIKAVKKILETIQTSEEVLYIKQEIESDTFLPLQVSKDNGVIPYQIHQMELKKILEGAKTHYDFLNHVEEDGICIADKILQLFAFKIPYYVGPLNTAAGNNSWMVRKKLADGTEKTGSIRPWNFEEMVDCDASAERFIRRMTNKCTYLLGKDVIPKNSLLYCEFMVWNELNNVKIKGEKLPATLKQLVFESLFKQKKRVSPKMFLSYLKSEGLDIDREELSGIDQTFCSSLTSYIDFKNIFGEEIEKHSIQQMVENIILWITLYGDEKKMLKRVIRKNYSKQQISEEQLKKICRLPYQGWGRLSKEFLAETEAVNQETGELFTIIQALRQTEDNLSQLLSAKYTFTEAIAKENAKILKPVSSVSYKELFEELVVSPAIKRSSWQVILIAEEIRKIMGKRPKKIFIEMARGAEEKKERKASRKDRLIELYQSCKDEERDWKGELENRTESDFRSIKLYLYYTQMGRCMYSNEPIELSQLSDATVYDRDHIYPQAKTKDDSLDNLVLVKRTINAEKRADILSPDIQKKMSGFWKMLKGRGFISEEKYNRLMRKTPLTDEELAGFINRQLVETRQSAKIVTNLLKQVYPHSAVVYVKAKAVSDFRNETLELVKVREMNDFHHAKDAYLNIVVGNVYHEKFTDNPLKWLQNTKNRTYSLKCIFTYDVIKKEKLIWKSGANGSLAVVKKYMNSNDIRYTRYALCNKGGFFDQQPVAKDANAGVPLKKGMDVKKYGGYKTITPACFALVESEDKKGKKQRSIEAVPLYLEKAFKRTLSFLLHIVKKIMV

SEQ ID NO: 8522 - protein, 614 aa, unidentified
  REGION 1..614: note = Description of Unknown:uncultivated organism sequence
RRRLDRRQQRVKLVQEIFASEIAKVDENFYRRIKESALWREDSSEPYVLFNDNGFTDREYHKKYPTVHHLICALMNEEKPFDVRLVYIACAWLAAHRGHFLNEVSKENISEILDFSKVYNEFAECFESGLPWTCSSTDFSEVLKKDLGVTAKYKELCLKLFNSPKPPKQLESEYGIDAMLKLMCGGKASAKDLFKNEEYAEIESFSLDKSDDELAPILSALGDDAETVLRIKALYDWALLYKVLSGCEYISEAKIKVYEQHKEDLKKLKYIVRKYAKEKYYKVFRSTATAHNYASYIGKGEKGCTKEDFCKFLKPILADIKADDADSGVYDELLSKLSANSLCPKQVNGDNRIIPHQVYWVELKKILDNAQEYLPFLTVPDADGYTPKEKLLSVFEFKIPYFVGPLNRSSKEFSWFVRKAEGKIYPWNFEKLIDFEKSEQAFIDRMTNTCTYIKSADVLPKCSLLQEKFQVLNEINTITVNGERIPSDVKRRLYYELFMTKKRVTKKAVKTFLLINNLYSKSDLETLAGIDDNIKSSLSSHIAFKNLLANGSITENEAEQIILRATYTENKYRFKKWVDASFASLSEADRRYISNLKFKDFARLSKELLCETFE

SEQ ID NO: 8523 - protein, 1360 aa, unidentified
  REGION 1..1360: note = Description of Unknown:uncultivated organism sequence
MKEINEYYLGLDMGEGSLGWAVTTPDYHVVKKAGKALWGVRLFESAKTAKERRVFRTGRRRIERRNQRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIKEDGAAGFEEAMADLGNVLGQFLDISLPVENNDACKEILKNRKLNKLEKLEQLGKLYDAGRDKSIKEIFRLIVGGTAHLAVIFRDETLKNMERGKISFDDAQYEEYKNDVQTILDDCFDVVAACETLHNWAVLAELMGNHKYISDAKVAIFNEHRKDLTVLKRLLKWDSNVYSRIFRMAGKNSYSAYVGLCKIHGKKVPIEKACTQEDFAGEIKKIIKNFPDSEDKKYILDKIERNEFLTKAVSKQNGVIPYQLHLVELNKILSNAERYLPFLKKEDEYGTVSDKIRKLFIFRIPYYVGPLNGHSPFAWAVRKDENGHIYPWNFERKIDIEASAEEFIRRMTNKCTYLLKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRFSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKRKTVSRKDRLLDLYKKCNDEIRHWSADIKKLGEEIKELSDGQLRSDKLYLYYTQMGRSMYTGKPICLGSLMAGADYDIDHIYPRSATGDDSLDNRVLVEKTENAKKGDHYPLSVEIQRERADFWKILLDKGLISKEKYHRLTRKTLLTDDEKAGFIGRQLVETRQSTKAVAEILKKAFPETKIIYTKARNVSRFRQYAGFVKVRDMNDYHHAKDAYLNIVVGNAFYTKFTSNPVHFLSEKNAVYSLNEKSFYQFPIQRGSTMAWEPGDNGTMAVVRKWMDKNNILYTRMPFEEKGGLFDQNIRKKGKGQVSLKAQGALSDIQKYGGYNKATASYFMLVKAEKNGKRIYLLETVPLHLSERLESIDDKTDFCRELWHKEGKGYKNPVICIPKIYKQSLFEVDGFREHISAKTGDRFVMRNAEQLCLNAESAQIIKNVLKFNQRKQVQKELKVTVHDKITEENLINIFEAFISKIQTSIYRNKFKKFVSLMIKEKGTFIELSMEDKCKCIGEILHLFQCNPVLSNLQLIGGEKASGKISMGKKFDGNEKVFLILQSVTGFFEKKILLAPYEKK

SEQ ID NO: 8524 - protein, 1378 aa, unidentified
  REGION 1..1378: note = Description of Unknown:uncultivated organism sequence
MMKELKNYFIGLDMGTTSVGWAVTDENYEIIKKNGKALWGIRLFEEAQTAAERRMHRISRRRIERRSRRIDLLQELFAQEICKKDPGFYERLNESGLYEEDKKVHQKNSLFNDVDFDDKAYYKEYPTIYHLRYDLMTKDRPFDVRLVYLAVHHILKHRGHFLFDSFQIDENGASGFDESFAAFGNALYRIRGISLDVRGTDTVKDIFRNKKLGVKEKAKALLQALGKEKEKDFKAMMTLAAGGTALLSDILGEEGLKDFEKNKVSFSGAQFEENEPDIMAELGDRYDLIAALHGLYNWSLLAELMGNYRYISEAKKAIYNKHKEDLKVLKRVLKQNPAVYAKIFKEPGSKSNKNYSAYVGVCKVKGKKAAIDKCSYEDFAKTLKSCLKDLPDSKDTEYISRELEQGTFLPKSVTKENGVIPYQLHLQELKKILANAKKYLPFLKIKDAYGTVSDKIISLFTFRIPYYVGPVNEHANSCWAVKKDKKGKVYPWNFSEKIDVEKSAEGFIRNLTNKCTYLIGEDVLPKNSLLYSEFTVLNELNNVRIGENAQKLSPELKEKVLENLFKKHKHVSRRKFINYFATEGIDKKEAESISGLDGDFKSSLSSLIDLTNILGNDFSREDGEQMIKDITIFGGDRKMLKSRLHREFPYLTPEQLTRLIHLSYQGWGRLSKELLVNLLPAEKSAGEVLVDKGSGEVLNIISAMEQTSYNLMELLSSRFGYAKAIEERNREKEGNGTISYQDVEDMYISPAVKRPLWQALKIVREIVKILGKEPSKIFIEMARENGEKGKRTISRKARLQELYKKCRDDSRDWAKELAEKPEEDFRSDRLYLYYTQMGRSMYTGKPIDINQLFDRNVYDIDHIYPQSLTGDDSLDNRVLVEKTVNAKKGDTYPLGSALDGCHIGGQIHIQDIQKEMRPFWRMLLEKGLISKEKYNRLSRTTPLTDTEKAAFIGRQLVETRQSTKACAELLSKACSEARIVYTKAGNASRFRQYGGFIKVRDMNDYHHAKDAYLNIVVGNVFDTRFTSNPIRFLKGNHPVYSLNVEALYGHRVSRGGVDAWIPAEKDDEGHIMAGHEGTMGTVRKWMRKNNILFTRMPLEGKGGLFDQTIMKKGKGQVPLKGDSPVSDIEKYGGYNKASVAYMMLVKAEEKGEPVYILESVPNYVKNQLKTDKERRAYCAGIWAAQGSRYTNPEICIPEIRIQSLFEMNGFKAHISGKTGNLYVMRNAQELCMDDLLAKILKNVLKFNNRKAVQKDAVVTAYDGITDENTLELYDFFADKLSHSIYRKKLSAQADFLDQSKDKFAGLPLEERCEVLGAILHLFQCNAVLSDFHLLGGSRQAGRIYLNKKIKAQDHVCLIVQSVTGFFEKRILLAPYGEK

SEQ ID NO: 8525 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFLDSEDKKYILDKIERNELLPKAVSKQNGVIPYQLHLVELNKILSNAERYLPFLKKEDEYGTVSDKIRKLFTFRIPYYVGPLNGHSPFAWAVRKDGNGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFCQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8526 - protein, 1330 aa, unidentified
  REGION 1..1330: note = Description of Unknown:uncultivated organism sequence
MERCGKNAAYLGLDIGSTSVGWAVSDETYRLCRVKGKDMWGVRLFEEAQTAAARRVARVQRRRYDRRNQRLALLQELFQAQIARVDPAFFQRMDAARLWSQDKPWKYTLFEQKGWTDREYHAQYPTVYHLRRALMTQDGPFDVRLVYLALHHILKKRGHFLYADLGDGQLPELEEIIRELELRFEDELGMELRCHDIDTLRPLLMDSTLSISARQKQLNAVFAAETKQQKTWVKALTGAKVKLSELYEDPTLEEAEQKEAEFRKAGYEDGLPVLEAVLGDRFALLEAWRSLYNWGVLQRLLGGASSISEAKVRQYEQNKKDLAELKAVLRADRTLYNRVFRATDVPGNYASIVGHAWVEGKKQTVKVCGHEDFCKFIEKVLDTLEQDERVQALRTRAKEGILLPKLISGDNSVIPYQLHRAEMEQILDRAAVYLPFLKEKDAEGLTPADKIRALLVFRIPYYVGPLNPHSPNSWFVRKTEGPIYPWNFEDRVDRVRSAQAFIDRMTSFCTYLRGCDVLPACSPIYERFTVLNELNPMTVKGEPLSIELKQAIFEQVFLKIRKPGIRNIVGFLRAQGYDVSREDLGGIDVQGGVKSSLRTTLALQEILGEKYDDAKAEEIVLAATYFGDDRRLLREKLRSLGLTDDVIGRLLRLHCAGWGRLSREMLCEVTSFVPGQPDGASILDTLWKTNETLMGLLSDRYTFAEAIEARNREVGEESLYDFIDELYVSPSVKRQIRQTVLVARELRKVIGHDPKKIFIEMARGKEKKPERKPKRKQTLLACYETFQNEAGALYETLMQTDNQRLRQDKIYLYYTQMGRCMYSGERIDLEELLRSESLYDIDHIYPRSRVKDDSIDNRVLVKRTLNEKKGNDYPLSHEIVEGQRAFWSMLLYRKLISREKYERLTRRTGFTDEELTSFAARQLVETRQGTKAVAQLLGRMMPDSEIVYVKAGLVSDFRHARSLPKVRELNDLHHAKDAYLNIVVGNIYNTQFTHSPMRYICEHRDNYTVNLDSLLKMEIHRGGVLAWDPADGGSIATVRRTMARNSPLVTMMPVIYSGILFDLQPKPQGQGQMPLKKGLPIEKYGGYNKVTGACFMLVEHTLRRRRVRSLIDVPLHLYPDAVSHPELALRHCIEMRDLKEPRIILPIIRMRALLSLDGYKMYITGRTNGNLCIQNANQLMVSEEWEQYIKKIVKAARESMEYERLRGGDGYRPNPRDGLCPEKNLALYDLFVQKMERMPYCQRMSGQRDKLLQARAAFEALDVAQQCCILCQLLNLFSRVGGEADLTGIGLVKNFGILHPSGMISGCAQALLIHQSPTGLYERVVDLNRL

SEQ ID NO: 8527 - protein, 788 aa, unidentified
  REGION 1..788: note = Description of Unknown:uncultivated organism sequence
MCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMHISPAVKRPLWQTLRVIKEIIHIMGKAPSRIFIEMARAEDEKKWKTVSRKDRLLDLYKKCKDEIRNWSADIKKLGEEIEELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRACGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8528 - protein, 576 aa, unidentified
  REGION 1..576: note = Description of Unknown:uncultivated organism sequence
MKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPEENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSSFAWAVRKDENGHIYPWNFERKIDIEASAEEFIRRMTNKCTYLVKKDVLPKNSLLYTEFMVLNELNNVRIGSAQEKLPPGMKVRVWERLFLKDKKITAKKCVLI

SEQ ID NO: 8529 - protein, 1278 aa, unidentified
  REGION 1..1278: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYAEDKTEPQQNALFDDVDYTDKDYHKEYPTVYHLRRAFIEGKDIRDPRLLYLAVHHIINNRGHFLFEGMDLSKVVDFETPFSILKEYLREEDFGFDFSNIDADALKESLKNKQGITQKKKDLYKLLGKEKGTLKSVCDLLAGGSGIKLTDLFNDESLAGETPDKISLSDSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCSYLVGEDVLPKDSLLYSEYSVLNELNNLKLSGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAELDFKKQIDAENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDILSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGSNVAWVAGNNGTIATVKKTCSKENILFTRYAFEQKGGLFDQQIMKKGKGQLPTKPSDPHMQGQTEQEWIDKYGGYNKLSGAYFCLVEYKDKGKIVRSIESVPLLVSAKIKNDPSDLEKYLKQALGTEELSVRIREIKFNTLFNHNGFLMHITGRQGNQLIFKPALQLKVNASDYAYIKKIVRFCEREKESKKAFTVSGFDGIEKDRNIELFDFFYQKTFKRYFYGPSCGNIEISVGEQEHIC

SEQ ID NO: 8530 - protein, 1371 aa, unidentified
  REGION 1..1371: note = Description of Unknown:uncultivated organism sequence
MKNKNDYYIGLDISTHSNGWAVTDENYNIIKRNGKSLWGTRLFDEAKTAKERKTLRAARRRLERRSWRIKLLQELFAQEICKKDPGFYVRMKESGFHKEDKTIHQPNSLFNDINFNDKAYHSSYPTIYHLRYALMTEDKAFDVRLVYLAIHHIMKHRGHFLFANLKTDEKGIALFEDSFNAYCNVVERILGDSLKTDKVENIKDLFKNKDLSKAKKEKALLECLDKVGDKRYKAMVTLAVGGTAQLSTVFNDENLKEKESSTTSVCFAKEDYESKEPEIMDKLGERFDLIAVLHDLYNWSLMAQIMKGHKFISEAKIENYDNHKSDLAVLKRVFKQNPEAYAHMFKEPGGKKEKANYSAYVGLCKVKRSKTPITKCSYEEFITELKKRLQQFPSNEDKEYIKQRIKNGEFLRKAVNKENSIIPYQLHLQELKNILAKAERYLPFLKEKDEYGTISDKIISLFTYRIPYYVGPMNEHANHCWIVKKDKNGRVLPWNFNEKIDTENTAEKFIRSLTNKCTYLVGEDVLPKNSLLYTKFTVLNELNSVKIGRNLQRLDEELKAKVLKNLFMVYKHVTKREFVTYLLTEGYNRDEIEPVNGIENGFNSNLGPWIDLKKIMGESFNYKDGEQIIRDITIFGNDKNMLKSRIRRMYPSLSSKQVENLSSLSYQGWGKLSKELLLNVIAEPGEKHEMLVDKATGKALNIISAMEKYPLNFMELLSDRYGYTKAIEEKNKGRWGEGEITYEDVEALHISPAVRRPLWQAMKIIREIVKIMGREPTRIFIKMARGDGVNGKATVSRKDKLFELYKKCKDDTRDWVKELGTQGNEDFRSDKLYLYYTQMGRSMYTGKPIDINELFNKNMYDIDHIYPQSFTGDDSLDNRVLVEKAVNSKKDAVYPLGDALNGCHIPWQNIHIEDVQKEMKPFWEMLCDKGFISKEKYKRLIRTTPLTNEEKAAFIGRQLVETSQSTKTCAELLSRAYPNTKIVYSKASNVSRFRQYGDFIKVSTMNDFHYAKEAYLNIVVGNVFYTKFTSSPLNFLKEKNSVYTLNTRSLYSRKISRGGVDAWIPPQKDKEGNIIPGHEGTMSTVRKWMSKNNILITRMTFEGKGGLFNQTIMKKGEGKLPLKGKLPLSDMSKYGGYTGVSLAHISLVRAKKGKKTVYMFESVPVYCAKTLKTKEDYVAYFKKVWKEENKDYEDPEILIPIIPLQSLIEVNGFKMHISGKNGNGYSVKNAQELCADDSFAAVLKKALKYNLSEQGEISDEEVSYLYDFFIDKLQNTIYSKKFDGIAKKLSSKRSKFSNLKLKDKCKVLKEVLQLFQCNSSPANLTVLGCADRTGLLTIGKNISEKDHVYLIEQSITGFYEKRILLNPYEGK

SEQ ID NO: 8531 - protein, 1349 aa, unidentified
  REGION 1..1349: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRDFIEGKDIRDPRLLYLAVHHIINNRGHFLFEGMDLSKVVDFETPFSILKEYLREEDFGFDFSNIDADALKESLKTKQGITQKKKDLYKLLGKEKGTLKSVCDLLAGGSGIKLTDLFNDESLAGETPEKISLSDSSIEDDRTALENILQDRIQLLDCLKAVYDWAILDEILSGSPYISFAKTQSYEKHKKDLALLKKTIKRLRPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCTYLVGEDVLPKDSLLYSEYSVLNELNNLKLSGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAEFDFKKQIDAENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGSNVAWVAGNNGTIATVKKTCSKENILFTRYAFEQTGGLFDQQIMKKGKGQLPTKPSDPHMQGQTEQEWIDKYGGYNKLSGAYFCLVEYKDKGKIVRSIESVPLLVSAKIKNDPSDLEKYLKQALGAEELSVRIREIKFNTLFNHNGFLMHITGRQGNQLIFKPALQLKVNASDYAYIKKIVRFCEREKESKKAFTVSGFDGIEKDRNIELFDFFTKKLSSDIFMVHHAATLKSLLANRSIFVDMSVEMQARTIYQILHIFRCNRMLADLTALQGAKSAGTVLMSKKISLNDKIMIINQSPTGLFENSVDLLTV

SEQ ID NO: 8532 - protein, 1383 aa, unidentified
  REGION 1..1383: note = Description of Unknown:uncultivated organism sequence
MKEIKKIFIGLDMGTNSVGWAATDENYEVIKKNGKALWGIRLFDEAQTAEDRRMHRIARRRIERRSRRIDLLQELFAQEICKKDPGFYERLNESGLYEEDKTVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFNAMMTLAAGGTASLSDIFNDEKLKDFEKNKVNFSGAQFEENEQDIMAELGDRYDLIAALHGLYNWSLLAELMGEHRYISEAKIAVYDKHKADLKVLKRVLKQSPDIYAKIFREPGSNANKNYSAYVGVCKVKGKKAAIEKCSYEDFAKTLKSCLKEMPDNNDKDYISRELDMGTFLPKSVSKENGVIPYQLHLQELKIILSKAEAYLPFLKVRDQYGTVSDKIISLFTFRIPYYVGPINEHANSCWVVKKDKQGKVYPWNFTEKIDIEKSAEGFIRNLTNKCTYLIGEDVLPKNSLLYSEFTVLNELNNVRIGETMQKLPLSLKEKVMDNLFSCYKHVSRTKFIKYLVSEGIDKKEAESISGLDGDFKSSLSSLIDMKHILGNDFSREDAEKMIKDITIFGGDKKMLKNRLHREFSYLTPEQLTSLTQLSYDGWGRLSKEFLVNLLPAEGNSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCKDDTRDWTKELKGKPEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPAYSLNTEALYGHKVSRNGVDAWIPAEKDERGQVIEGHEGTMKTVQKWMKKNNILFTRMPYEGKGGLFDQNIVKKKKGQKKKGLVPIKGKPPISDIEKYGGYNKASIAYIMLVQAEEKGKPVYLLESIPNYVKNKLTSDKERQAYCVKTWTVQENKCRNPQILIPKIRIQSLFEIDGFKAHISRKTNDQFAMRNAQELCMDNALAGVLKKVLKFIQRETVQKNAAITEYDGISNDNTSELYDFFVDKLSNSIYGKKFAAQADFLRQSKDKFMNLLLEERCEVLGSILHLFQCNPVLSDLRLLGGKKSTGTILLNKKIKPEDHVYLIEQSVTGFFEKRILLAPFGEK

SEQ ID NO: 8533 - protein, 990 aa, unidentified
  REGION 1..990: note = Description of Unknown:uncultivated organism sequence
MYTRGFCRGNKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDGNGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEIIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVTVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8534 - protein, 1399 aa, unidentified
  REGION 1..1399: note = Description of Unknown:uncultivated organism sequence
MNTAVSKDSRGSDYYLGLDIGTASVGWAVANTDYELVKEHRKYLWGVRLFDTADTAAERRLHRAARRRHQRRLQRQRLLKEIFEDKISEVDPHFFERLKESSYHREDRSGNFLSTLFNDESFKDTDYFAKFPTIFHLRSHLIHHPEERPDIRILYLAIHSILKHRGHFLFPGESLESISSFSLLFDELLKNIETSLQCTLHVSCTPETFGTILKKKRRTDKKNDLQEVLTLTRTTEEEIEETPKKLTSELIKALSGTPFLLSMLFKNDSYKDSEQDKIEFDEEGFEDLKESIEVLLEPEEYALIETLEGIYNWTLLSDILNGEKFISDAKVASYRNHKDDLKQLKLLVKKYAGSAYYKAFKDPSIQNNYAHYIGTGNKSGKKVQVAHKGKCLQEDVNKYFHNLLKPYQNDEDRDLDNMLEKLEQKSALPKQRVRDNRVIPHQLHLKELQIILENAKAYYPFLTIPDDDGYTPTQKIISMMTFRIPYYVGPLNTSHMEKEGKEGFCWMVRQQGKEDVPIFPWNWTEVVDKNASAEKFITRMTNSCTYLFNEEVLPKFSLLYNRYMVLNELNNLKVNGEPISVELKQKIYNELFLHSGKKTITLKMLQKFLVVNNIVNKGDVTTIEGIDNGFANSLKSHIDFAPYLEANILSVEDVEKIIEWKAYYVDDATILKEKITQELHEKLTSEQIDDITKLVRNYKGWGRLSRAFLEDIYHVDRATGEGYSIIHMMWETNENLMELLSSKYDYLDEIQRINNETLINKKFSYESLVRPLSVSPPVKRQIWQTLLIVHELKKVMGKAPKRVFIEMAREEREKKRTTSRKESLRILYDRCKNDISFNKALLESLDTKTDTELRNDRLYFYYTQMGRCPYCGGKIELDQMNNTQLYDIDHIYPQSLIKDDSLNNRVLAHKACNGEKGNSYPINPQWQNTMIGFWKVLLDRSLISKEKYARLTRTTPLSDEELFAFINRQLVETRQSTKVVASILKNLFQDEGTEIVYVKARNVSSFRTDFEIKKSRLVNDHHHAHDAYLNIVVGNAYHTKFTGDARNFIKELKRGDQYYNASNIFSRSIQRNGRLAWIADERYDANKGRPKSEKQETGTIATIRKMLRNHQVLVTRQAVEVSGALFKLQPLRKKKNLLPLKGSSQTLQDTTKYGGYNAPATAYFALVQHEKKGKEVRQFVPVPILYAEQFKQNPGTLLKYCEEELDLINAKIVIPQILLHELVQLKGYTMSLSGITGPQTVANNEIQLVLSDEDYDYVAQIEKYLSLLKKVKDPEVQENAEILAESLHICKQDNLTLYELLLAKERGSIYRYRPANQAKFLEEKRSIFESLDIKGQCEVLVQIINLFTCTPESANLTKLGGGSSSGIVKFQSQITDKEARLIHQSPTGIFTKSRRVYEI

SEQ ID NO: 8535 - protein, 1399 aa, unidentified
  REGION 1..1399: note = Description of Unknown:uncultivated organism sequence
MNTAVSKDSNQSEYYLGLDIGTASVGWAVTNAEYELVKKHRKHLWGVRLFDTANTAAERRLHRAARRRHQRRLQRQRLLKEIFQDKIDEVDPHFFKRLKESSYHTEDRSGSFLSILFNDESFKDTDYFTKFPTIFHLRSHLIHHPEEKPDIRILYLAIHSIMKHRGHFLFPGESLESVSSFNLLFDALLKNVEDSLQCALHVSCSPESLGAILKKKRRTDKKNELLKVLALTRTTEEEIEETPKKLITELIKALSGTPFLLSLLFENESYKESELDKIEFDKEGFEDKKDSIEVLLEPEEYALIETLEGIYNWTLLSDILNGEKFISDAKVSSYAEHKNDLKQLKLLVKKYAGSAYYKAFKDPSIQNNYAHYIGTGNKSGKKVQVVHKGKCLQEDVNKYLYNLLKPYQNDEDSILGSMLEKLEQKSALPKQRVRDNRVIPHQLHLKELQVILDNAQHYFPFLAIPDADGYTPHQKIVSMLTFRIPYYVGPLNTSHMEKGGNEGFCWMVRQQGKEDVPIFPWNWSDVVDKNASAEKFITRMTNSCTYLFNEEVLPKYSLLYNRYMVLNELNNLKINGEPISVELKQKIYNELFLKSGKKTITLKMLQKFLMTNNIINKGDTSTIEGIDNGFANSLKSYIDFAPYLETKILSGEEIEKIIEWKAYYVDDATILKEKIAQELHEKLTSEQIDDIAKLVRNYKGWGRLSRAFLEDIYHVDRATGEGYSIIHMMWETNENLMELLSSKYDYLDEIQRINNETLINKKFSYESLVKPLSVSPPVKRQIWQTLLVVHELKKVMGKAPKRVFVEMAREEREKKRTTSRKESLRILYDRCKNDITFNNALLESLETKTDAELRNDRLYFYYTQMGRCPYCGGKIELDQMNNSQLYDIDHIYPQSLIKDDSLNNRVLAHKTCNGGKGNSYPINPQWQNKMIGFWKVLLDRSLISKEKYARLTRTTPLSEEELFAFINRQLVETRQSTKVVASILKNLFQDEKTEIVYVKARNVSSFRADFEIKKSRLVNDHHHAHDAYLNIVVGNAFHTKFTADARNFIKELRRGDQFYNASNIFSRSIQRNGRSAWIADERYDDNRGKPKSEKQETGTIVTVRKTLRNHQVLVTRQAVEVSGALFKLQPLKKKKNLLPLKGSSQILQDTTKYGGYNAPATAYFALIEHEKKGKPVRQLVPVPILYAEQFKQDAKGLAKYCEENLDLENAKMIVPQILLHDKVQLKGFTMSLSGVTGPQIIANNEIQLVLSDEHYDYVAQTEKYLSLLKKVKDTEVEKNAEILAESLHITRQDNLQLYEQLLAKERDSIYKYRPANQAKFLEEKKSTFESLDIKAQCEVLVQIINLFTCTPESANLEKLEGGSSSGIVKFHSQITDREAKLIHQSPTGIFTKTRRIYEL

SEQ ID NO: 8536 - protein, 1399 aa, unidentified
  REGION 1..1399: note = Description of Unknown:uncultivated organism sequence
MNTAVSKDSRGSDYYLGLDIGTASVGWAVTNTDYELVKEHRKYLWGVRLFDTADTAAERRLHRAARRRHQRRLQRQRLLKEIFEDKISEVDPHFFERLKESSYHREDRSGNFLSTLFNDESFKDTDYFAKFPTIFHLRSHLIHHPEERPDIRILYLAIHSILKHRGHFLFPGESLESISSFSLLFDELLKNIETSLQCTLHVSCTPETFGTILKKKRRTDKKNDLQGVLTLTRTTEEEIEETPKKLTSELIKALSGTPFLLSMLFKNDSYKDSEQDKIEFDKEGFEDLKESIEVLLEPEEYALIETLEGIYNWTLLSDILNGEKFISDAKVASYRNHKDDLKQLKLLVKKYAGSAYYKAFKDPSIQNNYAHYIGTGNKSGKKVQVAHKGKCLQEDVNKYFHNLLKPYQNDEDRDLDNMLEKLEQKSALPKQRVRDNRVIPHQLHLKELQIILENAKAYYPFLTIPDDDGYTPTQKIISMMTFRIPYYVGPLNTSHMEKEGKEGFCWMVRQQGKEDVPIFPWNWTEVVDKNASAEKFITRMTNSCTYLFNEEVLPKFSLLYNRYMVLNELNNLKVNGEPISVELKQKIYNELFLHSGKKTITLKMLQKFLVVNNIVNKGDVTTIEGIDNGFANSLKSHIDFAPYLEANILSVEDVEKIIEWKAYYVDDATILKEKITQELHEKLTSEQIDDITKLVRNYKGWGRLSRAFLEDIYHVDRATGEGYSIIHMMWETNENLMELLSSKYDYLDEIQRINNETLINKKFSYESLVKPLSVSPPVKRQIWQTLLIVHELKKVMGKAPKRVFIEMAREEREKKRTTSRKESLRILYDRCKNDISFNKALLESLDTKTDVELRNDRLYFYYTQMGRCPYCGGKIELDQMNNTQLYDIDHIYPQSLIKDDSLNNRVLAHKACNGEKGNSYPINPKWQNTMIGFWKVLLDRSLISEEKYARLTRTTPLSDEELFAFINRQLVETRQSTKVVASILKNLFQDENTEIVYVKARNVSSFRTDFEIKKSRLVNDHHHAHDAYLNIVVGNAYHTKFTRDVRNFIKELKRGDQYYNASNIFSRSIQRNGRLAWIADERYDANKGRPKSEKQETGTIATVRKMLRNHQVLVTRQAVEVSGALFKLQPLRKKKNLLPLKGSSQTLQDTTKYGGYNAPATAYFALVQHEKKGKEVRQFVPVPILYAEQFKQNPGTLLKYCEEELDLINAKIVIPQILLHELVQLKGYTMSLSGITGTQIIANNEIQLVLGEEQYDYIAQIEKYLSLLKKVKAPEIKENAEILAESLHICKQDNLTLYELLLAKERDSIYRYRPANQAKFLEEKRSVFESLDIKGQCAVLVQIINLFTCTPESANLTKLGGGSSSGIVKFQSQIADKEARLIHQSPTGIFTKSRRVYEI

SEQ ID NO: 8537 - protein, 1399 aa, unidentified
  REGION 1..1399: note = Description of Unknown:uncultivated organism sequence
MNTAVSKDSRGSDYYLGLDIGTASVGWAVANTDYELVKEHRKYLWGVRLFDTADTAAERRLHRAARRRHQRRLQRQRLLKEIFEDKISEVDPHFFERLKESSYHREDRSGNFLSTLFNDESFKDTDYFAKFPTIFHLRSHLIHHPEERPDIRILYLAIHSILKHRGHFLFPGESLESISSFSLLFDELLKNIETSLQCTLHVSCTPETFGTILKKKRRTDKKNDLQEVLTLTRTTEEEIEETPKKLTSELIKALSGTPFLLSMLFENDSYKDSEQDKIEFDKEGFEDLKESIEVLLEPEEYALIETLEGIYNWTLLSDILNGEKFISDAKVASYRNHKDDLKQLKLLVKKYAGSAYYKAFKDPSIQNNYAHYIGTGNKSGKKVQVAHKGKCLQEDVNKYFHNLLKPYQNDEDRDLDNMLEKLEQKSALPKQRVRDNRVIPHQLHLKELQIILENAKAYYPFLTIPDDDGYTPTQKIISMMTFRIPYYVGPLNTSHMEKEGKEGFCWMVRQQGKEDVPIFPWNWTEVVDKNASAEKFITRMTNSCTYLFNEEVLPKFSLLYNRYMVLNELNNLKVNGEPISVELKQKIYNELFLHSGKKTITLKMLQKFLVVNNIVNKGDVTTIEGIDNGFANSLKSHIDFAPYLEANILSVEDVEKIIEWKAYYVDDATILKEKITQELHEKLTSEQIDDITKLVRNYKGWGRLSRAFLEDIYHVDRATGEGYSIIHMMWETNENLMELLSSKYDYLDEIQRINNETLINKKFSYESLVKPLSVSPPVKRQIWQTLLIVHELKKVMGKAPKRVFIERAREEREKKRTTSRKESLRILYDRCKNDISFNKALLESLDTKTDTELRNDRLYFYYTQMGRCPYCGGKIELDQMNNTQLYDIDHIYPQSLIKDDSLKNRVLAHKACNGEKGNSYPINPQWQNTMIGFWKVLLDRSLISKEKYARLTRTTPLSDEELFAFINRQLVETRQSTKVVASILKNLFQDENTEIVYVKARNVSSFRTDFEIKKSRLVNDHHHAHDAYLNIVVGNAYHTKFTRDVRNFIKELKRGDQYYNASNIFSRSIQRNGRLAWIADERYDANKGRPKSEKQETGTIATVRKMLRNHQVLVTRQAVEVSGALFKLQPLRKKKNLLPLKGSSQTLQDTTKYGGYNAPATAYFALVQHEKKGKEVRQFVPVPILYAELFKQNPGTLLKYCEEELDLINAKIVIPQILLHELVQLKGYTMSLSGITGPQTVANNEIQLVLSDEDYDYVAQIEKYLSLLKKVKDPEVQENAEILAESLHICKQDNLTLYELLLAKERGSIYRYRPANQAKFLEEKRSIFESLDIKGQCEVLVQIINLFTCTPESANLTKLGGGSSSGIVKFQSQITDKEARLIHQSPTGIFTKSRRVYEI

SEQ ID NO: 8538 - protein, 1360 aa, unidentified
  REGION 1..1360: note = Description of Unknown:uncultivated organism sequence
MNKDLNNIDYYIGLDCGTSSVGFAVTDTNYNILKFNGKRMWGSHLFEEAKTAAGRRGFRTARRRLERRRKRILLLQEIFAEEICKVDPTFFIRLNDSKYILEDKTTPDLNILFNDKNYKDKDFFKIYPTAYHLRKALMTEDIKDPRLLYLGIQHILKNRGHFLFPGEGMKAVESIKPLVDDIQNVFEELFDDVTFEYTSIEKLQEALMSKRNSEKKEKLEKEIIISDTKLKASVVRILLGYKVKTTTLFKKEGDEIPDVEFKKASFEESDLPELQDRLSDEEFAFIKAAKGIYDWTLLGSIMSGHLYISDAKIELFDSNKADLKHLKEAIKTYAPDKYESFFHSDEKGSYSSYTGKIHGDHVVKRVKRTGTDEFYKKIKNLLEKVPKDDEHVKHILDAIENDSFMPLLKSFRNGTIPYQMNKIELDAILANCSKNFEFLEKKDPDGFSATEKIKELLKFRVPYYVGPLGSNPYGKETKGKNSWVERKTSGRVLPWNIEQKIDYESSAEKFIERMTNKCTYCKDQDVLPKNSLEYSKYMVLNELNNLRICGDRLSVPRKQEIFNELFKKEKKVSISKLTKYINDNCWYSGKIKKEDITGIDGDLKASLSSYFDFKDFLESHRLKADDVDRIIKWATVFSEGGDMLRKRIEREFGEVLTKEEIDKTSKLKYAGWGRFSHKFLYEIQAINKETGELMSVMRMLWETQNNLMELLSNKYEFIEQITKPKTIGKLDYSIVDEMYVSPAVKKETWQTLRIVDELIRIMGHNPQKVFVEVTRSEQEKKRTVSRKQTLIDTLKDATKTDSNYINELRELISKLEEKSESDVSRQDKLYLYFSQCGKCMYTGERIDIEDIYDINNYDIDHIFPRSRTNDDSLTNRVLVKRKKNGGKSDVYPIDDSIRKKMQNFWKFLYEKKFIPKEKYDRLVRTSPLSDEEIKGFINRQLVETSQTVKQVTDTLKSLFGEETKVVYSKARNVSDFRNKFGFVKCRTMNDLHHAKDAYLNIVVGNVYDTKYSSNFYLQANGHGYGNLTKPFDFDVKNAWKAENDGTIASVTKTMNRNDILFTRQPVETKGELFKVQLVKKGSRKGALPAKVSDKKLQSAIGSFENTEGAYDNWTSKYGGYNSLSTSYFAVIKHEEKSNKFVSFVPISMIDAKRIGKPEALLKYCTTTLGLINPTIVRSKLLINTQLKIDGYLFAITGKSTGGKALTLSSNVPLVLSAQSQQTVKNIESFFKKSEKNKDLQPTPKFDKISTENTLDLYCELQKKSKSPIYNKRPGNQSDVLENGVSLFEKLSLLERCKAIREILNYYAMEGNGQSDFTAIGGSKTCGKLTKKAGFDITKSNILIFDQSITGLFEEIEEIKA

SEQ ID NO: 8539 - protein, 1378 aa, unidentified
  REGION 1..1378: note = Description of Unknown:uncultivated organism sequence
MKEIKKIFIGLDMGTTSVGWAATDENYEVIKKNGKALWGIRLFDEAQTAEDRRMHRIARRRIERRSRRIDLLQELFAQEICKKDPGFYERLNESGLYEEDKRVHQTNSLFNDVDFNDKAYYKKYPTIYHLRHALMTENHPFNVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAAGGTASLSDIFNDEKLKDFEKNKVNFSSAQFEENEPDIMAELGDRYDLIAALHGLYNWSLLAELMGEYHYISEAKIAVYDKHKADLKVLKRVLKQRPDIYAKIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVKDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGETMQKLPLSLKEKVMDNLFSCYKHVSRTKFIKYLVSEGIDKKEAESISGLDGDFKSSLSSLIDMKHILGNDFSREDAEKMIQDITIFGGDKKMLKNRLHREFSYLTSEQLTSLTRLSYDGWGRLSREFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHQAYSLNTEALYGHKVSRSGVDAWIPAEKDEKGQVIEGHEGTMGTVRKWMRKNNILFTRMPYERKGELFKENILKKGKGQVPIKGNSPVSDIKKYGGYNMAKVAYMMLVKREEKGKSVYLLESIPIYLKESLKTDNERLEYCKKIWDAQGDKYINPEICISKILFQSLLEIDGFKAHISRKTNNRFAMRNAQELCMDNALAGVLKNVLKFIHRKTVQKDAVITEYDGVSDDNTLALYDLFVKKLSSSIYRKKYATQADFLCQSKDKFKNLPLEERCEVLGSILHLFQCNPVLSDLHLLGGKKSTGTILLNKKIKPEDHVYLIEQSVTGFFEKRILLAPLGEK

SEQ ID NO: 8540 - protein, 1345 aa, unidentified
  REGION 1..1345: note = Description of Unknown:uncultivated organism sequence
MKNEKKSFGEYYLGIDAGTDSVGWAVTDGNYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVVDFETPFSVLKEYLREEDFGFDFSNIDADALKESLKTKQGITQKKKDLYKLLGKEKGTLKSVCDLLAGGSGIKLTDLFNDESLAGETPEKISLADSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCTYLVGEDVLPKDSLLYSKYSVLNELNNLKLNGEPLKQEDKENIIKEIYEKKNKVKIKDIANYYKRNGFDVKPDDFTGFHEELKSSLRSYNLFFSLRGEKLDESAVEEAIRAVVLFGNDKKMLSQRLRNIKNGFFSETEINRISGFKFSDWGRLSKKLLTGIKETGETFNIIEALRVTNKNLMQLLSSEFDFKKKIDEENEKINGGIPEFSYDTLVKDSYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRSAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGNNVAWVAGNNGTIATVKKTCSKENILFTRYAFEQKGGLFDQQIMKKGKGQLPTKPSDPHMQGQTEQEWIDKYGGYNKLSGAYFCLVEYKDKGKTVRSIESVPLLVSAKIKNDPSELEKYLKQALGTEELSVRIREIKFNTLFNHNGFLMHITGRTGDQLVFKPALQLKVNASDYAYIKKIVRFCEREKESKKAFTVSGFDGIEKDRNIELFDFFTKKLSSDIFMVHHEPTLKSLLANRNIFVDMSVEMQARTIYQILHIFRCNRMLADLTALQGAKSAGIVRMSKRISSKDKTMIINQSPTGLFENSVDLLTV

SEQ ID NO: 8541 - protein, 1332 aa, unidentified
  REGION 1..1332: note = Description of Unknown:uncultivated organism sequence
MSIMKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDGNGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEIIIKDITLFGADKKILRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMSISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGK

SEQ ID NO: 8542 - protein, 1395 aa, unidentified
  REGION 1..1395: note = Description of Unknown:uncultivated organism sequence
MMKEFKNYFIGLDMGTTSVGWAVTDENYEIIKKNGKALWGIRLFDEAQTAEDRRMHRIARRRIERRSRRIDLLQELFAQEICKKDPGFYERLNESGLHEEDKSIRQANSLFNDDDYDDKAYHKKYPTIYHLRHALMTENHPFDVRLVYLAIHHILKHRGHFLFENFQVDENGVSGFEESFAAFGNALEHIKGESLDMGKEEEMKALCKDKKLGVKHKALALAQCLGRSKDNDFKDMMSLAAGGQATLSKIFKDEGLKDFSKNKVSFSDSQFENDKPEIIAKLGDRYDLIAALHDLYNWSFLAELMRGHKYISEAKIEIYDKHKEDLALLKKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSVENGAIPYQLHLQELKIILSKAEAYLPFLKVKDQYGTVSDKVISLFTFRIPYYVGPINEHAGSCWVVKKDKQGKVYPWNFTEKIDIEKSAEGFIRNLTNKCTYLIGEDVLPKNSLLYSEFTVLNELNNVRIGETMQKLPLSLKEKVMDNLFSCYKHVSRTKFIKYLVSEGIDKKEAESISGLDGDFKSSLSSLIDMKHILGNDFSREDAEKMIKDITIFGGDKKMLKSRLHREFSYLTSEQLTSLTRLSYDGWGRLSREFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTTSLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTEALYGHKVSRNGVDAWIPAEKDEKGQVIEGHEGTMGTVRKWMRKNNILFTRMPYEGKGELFDQNIVKKKKGEKKKGKVPIKSKPPISDIEKYGGYNNASIAYIMLVQAEEKGKPVYLLESIPNYVKNKLTSDKERQEYCVMTWTAQKNKYRNPQILIPKIRKQSLFEIDGFKAHISRKTDNRFAMRNAQELCMDNAQAKVLKNILKFIQRKKVQKNAAITEYDGISDDNTLALYDCFVDKLSSSIYGKEFAMQADFLRQSKNKFTNLSLEERCEVLGSILHLFQCNPVLSDLRLLGGKKSTGTIRLNKKIKPEDHVYLIEQSITGFFEKRILLAPFGEK

SEQ ID NO: 8543 - protein, 1349 aa, unidentified
  REGION 1..1349: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVVDFETPFSVLKEYLREEDFGFDFSNIDADALKESLKTKQGITQKKKDLYKLLGKEKGTLKSVCDLLAGGSGIKLTDLFNDESLAGETPEKISLSDSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWKFEQKVDLYASAEQFINRMTNKCSYLVGEDVLPKDSLLYSEYSVLNELNNLKLSGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAELDFKKQIDAENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLKAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGNNVAWVAGNNGTIATVKKTCSKENILFTRYAFEQKGGLFDQQIMKKGKGQLPTKPSDPHMQGQTEQEWIDKYGGYNKLSGAYFCLVEYKDKGKIVRSIESVPLLVSAKIKNDPSDLEKYLKQALGTEELSVRIREIKFNTLFNHNGFLMHITGRQGNQLIFKPALQLKVNASDYAYIKKIVRFCEREKESKKAFTVSGFDGIEKDRNIELFDFFTKKLSSDIFMVHHAATLKSLLANRSIFVDMSVEMQARTIYQILHIFRCNRMLADLTALQGAKSAGTVLMSKKISLNDKIMIINQSPTGLFENSVDLLTV

SEQ ID NO: 8544 - protein, 1393 aa, unidentified
  REGION 1..1393: note = Description of Unknown:uncultivated organism sequence
MMKEIKNYFIGLDMGTTSVGWAATDENYEIIKKNGKALWGIRLFDEAQTAEDRRMHRIARRRIERRSRRIDLLQELFAQEICKKDPGFYERLNQSGLHEEDKKVHQPNSLFNDVDFNDKAYHKKYPTIYHLRHALMTENHPFDVRLVYLAIHHILKHRGHFLFENFQVDENGVSGFEESFAAFGNALEHIKGESLDMGKEEEMKALCKDKKLGVKHKALALAQCLGRSKDNDFKDMMSLAAGGQATLSKIFKDEGLKDFSKNKVSFSDSQFENDKPEIIAKLGDRYDLIAALHDLYNWSFLAELMRGHKYISEAKIEIYDKHKEDLALLKKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSVENGAIPYQLHLQELKIILSKAEAYLPFLKVRDQYGTVSDKIISLFTFRIPYYVGPINEHAGSCWVVKKDKHGKVYPWNFTEKIDIEKSAEGFIRNLTNKCTYLIGEDVLPKNSLLYSEFTVLNELNNVRIGETMQKLPLSLKEKVMDHLFSCYKHVSRTKFIKYLVSEGIDKKEAESISGLDGDFKNSLSSLIDMKHILGNDFSREDAEKIIKDITIFGGDKKMLKNRLQREFSYLTPEQLTSLTQLSYDGWGRLSKEFLVNLLPAEGNSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCKDDTRDWTKELKGKPEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFNTRFTANPLNFLKGNHQAYSLNTEALYGHKVSRNGVDAWIPAEKDEKGQVMAGHEGTMGTVRKWMRKNNILFTRMPYEGKGGLFDQNIMKKEKGQVPIKGDSPISNIKKYGGYNKAKVAYFVLTQSKLNKKTVYTLEAIPLILKNSIQSNEDKETYIQKQWRKNGKKMEHPIVCLGHIPVQSLLEINGFKVHLSGKNGKDILLRNAEQLCINEADTAVLKKILKFNQRAAMSKKGEEIFINSFDNIQEEDLNRLYHVFEDKLTNQIYKVKLEKQAAVLKKGEETFNRLSPEQKCKLIGEILHLCQCKATHADLRLIGGAKKAGILTMGTQIYPKDHVYLIEQSVTGFFEKRILLAPFGEK

SEQ ID NO: 8545 - protein, 1357 aa, unidentified
  REGION 1..1357: note = Description of Unknown:uncultivated organism sequence
MNKDLNNIDYYIGLDCGTSSVGFAVTDTNYNILKFNGKRMWGSHLFEEAKTAAGRRGFRAARRRLERRRKRILLLQEIFAEEICKVDPTFFIRLNDSKYILEDKTTPDLNILFNDKNYKDKDFFKIYPTAYHLRKALMTEDIKDPRLLYLGIQHILKNRGHFLFPGEGKKAVESIKPLVDDIQNVFEELFDDVTFEYTSIEKLQEALMSKRNSEKKEKLEKEIIISDTKLKASVVRILLGYKVKTTTLFKKEGDEIPDVEFKKASFEESDLPELQDRLSDEEFAFIKAAKGIYDWTLLASIMSGHLYISDAKIELFDSNKADLKHLKEAIKTYAPDKYESFFHSDEKGSYSSYTGKIHGDHVVKRVKRTGTDEFYKKIKNLLEKVPKDDEHVKHILDAIENDSFMPLLKSFRNGTIPYQMNKIELDAILANCSKNFEFLEKKDPDGFSATEKIKELLKFRVPYYVGPLGSNPYGKETKGKNSWVERKTSGRVLPWNIEQKIDYESSAEKFIERMTNKCTYCKDQDVLPKNSLEYSKYMVLNELNNLRICGDRLSVPRKQEIFNELFKKEKKVSISKLTKYINDNCWYSGKIKKEDITGIDGDLKASLSSYFDFKDFLESHRLKADDVDRIIKWATVFSEGGDMLRKRIEREFGEVLTKEEIDKTSKLKYAGWGRFSHKFLYEIQAINKETGELMSVMRMLWETQNNLMELLSNKYEFIEQITKPKTIGKLDYSIVDEMYVSPAVKKETWQTLRIVDELIRIMGHNPQKVFVEVTRSEQEKKRTVSRKQTLIDTLKDATKTDSNYINELRELISKLEEKSESDVSRQDKLYLYFSQCGKCMYTGERIDIEDIYDINNYDIDHIFPRSRTNDDSLTNRVLVKRKKNGGKSDVYPIDDSIRKKMQNFWKFLYEKKFIPKEKYDRLVRTSPLSDEEIKGFINRQLVETSQTVKQVTDTLKSLFGEETKVVYSKARNVSDFRNQYGFVKCRSMNDLHHAKDAYLNIVVGNVYDTKYSSNFYLQANGHGYGNLTKLFDFDVKNAWKVGASGTLSVVAKTMNRNDILFARQPVTKSGQLFDLQLVKKGAKKGALPAKVSDKKLQSAIESFKNKETAYDNWTAKYGGYNSLATSHFAVIKHEEKNKRFVSFVPISMIDAKRLEKPEALLEHCTTTLGLINPTIVRSKLLINTQLKIDGYLFAIAGKTEDRITLKSNVPLLLDNDSQKTLKKLESFNRKKTQFRGIAISSEHDGITEENITNLYEALMKKSNSKIFSIRPASQAKLITEKYGTFKKLSLQDKCSVVTSLLDYFGMTGGVSDLKLLGGKSSVGAIKKPGKYNTTNSSIKIVDQSITGLFEEIEEIKA

SEQ ID NO: 8546 - protein, 1402 aa, unidentified
  REGION 1..1402: note = Description of Unknown:uncultivated organism sequence
MKKRIYCDYYIGIDAGTDSVGWAVTDEYYNILKFRDKTMWGIRLFDEANPAAERRTHRTQRRRYGRRAQRTKLLQELFAEEITKKDPGFFLRMKESKYLPEDRKYDFKYLLFNDDNYTDGDFHKDYPTAYRLRKAFLDGKNISDPRLLYLAVHHIIINRGHFLFDGVNVENVTKFETVFNSLVEYINDNFDSESDIKKITDVDTAKFSEILKSKNTVTAKKEALYELFGVKKGQLKAVCDLLTGSSSVKLSDLFDNETLNSAENIKIIFSDSSYRDNHDIYEEVLEDKVEFTDYLKAVYDWSVLADILGEHEYISEVKDSEYEQYGEDLKKLQRAVKKYCPDRMNSFFYSPDNGRNYCAYAGSCNTGGKKYSRLKWKKKDNEKKKTVQECFYKVVKEMLNEHLDDEDVKYIFDRIADGSFLIKLRTSKNCIFPYQLNELELRKILKNAENNFPFLKEKDESGLTVSDKIMKLLTFRIPYYVGPLNDEHKGKNSNCWMVRRDNSKDRITPWNFENKVDIEQSAQEFIFRMTNKCTYLYGEDVLPKNSLLYSEYEVLNELNNLSLNGERLNVEDKKDIIEKVFKQKNKVKIKDIVNYYRSVGKEVSADDFSGLSDMKEFKSSLKSYRDFDKILGGRFNYNYAEEAILAVLLFSGDKKILTSRLKKIGGGYFTDDEIKKISSLRYSDWGRFSKKLLTGVYSAYSQTGEYMNIITAMRETTCNFMETQGQNFGFKDEIQKINSEVMPKINEFSYDALVKDLYVSPKIKRSVWQTLLIVREIVKITGHEPKKIFIEMARGTDGTSKTPDSRKKKLQDFYKNCQKEKFEIIKSIDFEGLNQSLKARDDSELRSDKLYFYYSQLGRDMYTGEEISLDNFSNYDKDHIYPRSLTKDDSLDNLVLVKKTINQDEKKAVYPIPNGIIKPKARELWEVLLKNGLISKEKYYRLTRTTEFSLEERASFVNRQIIETQQSTKAVVNVLKQVFPKSAVVGVKAGIVKDFKDKYKIEKVRMVNDNHHAKDAYVSIISGNVFDTKFKHNVWAYFKNNDFEKYTLNTSIYDSNVGSKEKPAWKGGANGSIKTIKKIIADEQSILYTRYAFIRDGSFFDENLNPKPKPKSKSTLIPSKTGDEHLINQSDREIVKKYGGYSSKYAYFYLVEDSDETRSIVSVPAYLADSAEKDSAVLKNYLKNYAKIKEPKILMKKIKIGTLFCIDGFRVYLSGRKSEDDLRFKPGVQLVLPEDMYNYSKKIEVFMKHYPKFVENELNESEIDYYKFDSNKNLKLYDFFLERLLDNPFCKYARTKNSKSDYEQLNEKRTDFINLSMYKQVVVLFRLFKIFRCNAECAKFEDNFDTNFKIEGNLGEMFGNKKIDIITGKGNGKKSIYILNQSPTGLLEHKAVNLHSEKLKEK

SEQ ID NO: 8547 - protein, 1381 aa, unidentified
  REGION 1..1381: note = Description of Unknown:uncultivated organism sequence
MKEIKKIFIGLDMGTNSVGWAATDENYEVIKKNGKALWGIRLFDEAQTAEDRRMHRIARRRIERRSRRIDLLQELFAQEICKKDPGFYERLNESGLYEEDKRVHQTNSLFNDVDFNDKAYYKKYPTIYHLRHALMIEHHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAAGGTASLSDIFNDEKLKDFEKNKVNFSSAQFEENEPDIMAELGDRYDLIAALHGLYNWSLLAELMGEHHYISEAKIAVYDKHKADLKVLKRVLKQSPKAYAEIFREPGSSANKNYSAYVGVCKVKGKKAAIEKCSYEDFTKTLKSCLKDMPDNNDKDYISRELNMGTFLPKSVSKENGVIPYQLHLQELKIILSKAEAYLPFLKVRDQYGTVSDKIINLFTFRIPYYVGPINEHAGSCWVVKKDKQGKVYPWNFTEKIDIEKSAEGFIRNLTNKCTYLIGEDVLPKNSLLYSEFTVLNELNNVRIGETMQKLPLRLKEKVMDNLFSRHKHVSRTKFIKYLVSEGIDKKEAESISGLDGDFKSSLSSLIDMEHILGNDFSREDAEKMIKDITIFGGDKKMLKTRLHREFSYLTSEQLTSLTRLSYDGWGRLSREFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTTTLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTEALYGHKVSRSGVDAWIPAEKDEKGQVMAGHEGTMGTVRKWMRKNNILFTRMPLEGKGGLFDQNIMKKGKGQVPLKGDSPISNIEKYGGYNKAKAAYFVLTQSKLNENTVYTLETIPLILKSSIQSNKDKEIYIQKQWRKNGKKMEHPIVCLGHIPVQSLLEINGFKVHLSGKNGKDFLLRNAEQLCINEADAAVLKKILKFNQRASLSQKGEEISINSFDNIQEEDLNRLYHVFEDKLTNKIYKVKLGKQAAVLKKGEEMFNRLSPEQKCKLIGEILHLCQCNAKHADLRLIGGAKNAGALTMTTQIYPKDHVYLIEQSVTGFFEKRILLAPFGEK

SEQ ID NO: 8548 - protein, 1378 aa, unidentified
  REGION 1..1378: note = Description of Unknown:uncultivated organism sequence
MKEIKKIFIGLDMGTTSVGWAATDENYEVIKKNGKALWGIRLFDEAQTAEDRRMHRIARRRIERRSRRIDLLQELFAQEICKKDPGFYERLNESGLYEEDKTVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAVGGTASLSDIFNDEKLKDFEKNKVNFSSARFEENEPDIMAELGDRYDLIAALHGLYNWSLLAELMGEHHYISEAKIAVYDKHKADLKVLKRVLKQSPKAYAEIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVKDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGETMQKLPLRLKEKVMDNLFSCHKHVSRTKFIKYLVSEGIDKKEAESISGLDGNFKNSLSSLIDMKHILGNDFSREDAEKIIQDITIFGGDKKMLKKRLHREFSYLTPEQLTSLTRLSYDGWGRLSRELLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTEALYGHKVSRNGVDAWIPAEKDEKGQVIDGHEGTMGTVRKWMRKNNILFTRMPLEGKGGLFDQNIMKKGNGQVPLKGDSPISDIEKYGGYNKASIAYMMLVQAEEKGKPVYLLESIPNYVKNKLTSDKERQEYCVRTWTAQGNKYRHPQILIPKVRIQSLFEIDGFKAHISGKTDDRFVMRNAQELCMDNALAGVLKNILKFIHRKTVQKDAVITEYDGVSDDNTLALYDFFVDKLSSSIYGKKFATQADFLRQSKDKFMNLPLEERCEVLGSILHLFQCNAVLSDFHLLGGSRQAGRIYLNKKIKAQDHVYLIEQSVTGFFEKRILLAPFGEK

SEQ ID NO: 8549 - protein, 1358 aa, unidentified
  REGION 1..1358: note = Description of Unknown:uncultivated organism sequence
MKNEKRTYPDYFIGIDAGTDSVGWAVTDEQYNILKFGKKAMWGIRLFDEANPAAERRMYRTQRRRYGRRAQRTKLLQELFAEEITKKDPGFFLRMKESKYLPEDRKYDFKYLLFNDDNYTDGDFHKEYPTVYHLRKAFLDGKNISDPRLLYLAVHHVIINRGHFLFDGVNVENVTKFETVFNSLVEYINDNFDSESDIKKITDVDTAEFSEILKSKSTVTAKKKALYELFGVKKGQIKAVCDLLAGSSSVNLSDLFDNETLNSSEKNKITFSSSSYQDEHDSYEEILDGDIIFTDLLKSVYDWSILADILGDNSYISQSKVKSYDKHRADLKLLKKVVNKHCRDKYYDLFKSDKNDKNYCAYSGMCKIGGKKKEIKRAKLDDFYAEIKKILKPFDDDDDVKIIFSDIETKSFLPKQISTENCALPYQLNEFELKRILSNAGNNFSFLKEKDESGITVSDKIMKLLTFRIPYYVGPLNDEHKGKNSNCWMVRRDNSKDRITPWNFENKVDIEQSAQEFIFRMTNKCTYLYGEDVLPKNSLLYSEYEVLNELNNLSLNGERLNVEDKKDIIEKVFKQKNKVKIKDIVNYYRSVGKEVSADDFSGLADMKEFKSSLKSYRDFDKILGDRFNCNYAEEAILAVLLFSGDKKILTSRLKKIGGGYFTDDEIKKISSLRYSDWGRFSKKLLTGVYSAYSQTGEYMNIITAMRETTCNFMETQGQNFGFKDEIQKINSEVMPKINEFSYDALVKDLYVSPKIKRSVWQTLLIVREIVKITGHEPKKIFIEMARGTDGTSKTPDSRKNRLSELYKKCGEDSGVLYDSLAKHTDSDLRKTALYLYYTQMGKCMYSGEDIELDDLFDKNIYDIDHIYPQSKTKDDSLDNKVLVKKKLNLDKSDKFPIPSHIITDKARENWIACKNAGLISKEKYERLTRKTELTADELAGFINRQLVETRQSTKAVAEILTEMFPDTAIVYSKASNADVFKKYFDIPKVREVNDYHHARDAYINIVVGNVFDVKFTRNAVRFIKSGKQYSLNECMYDFPVGNKDNPAWIPGDDGTISTVKKVCSRENILYTRMPYTQCGTLYDVQLLKKGKGQFPAKPGDCHFDGQTNEEIINKYGGYNKIKGAYFCLVEHTDKKNNRVRSIEYVPVYLADSIEKNPSLLEKYVSETLGLKDADVRIRRIKMDSLFSYNGFLMNLSGRTGSRLIFKPAVQLRLNMGYYKYLKNIVKFHDRQRIMKNTLTVSDFDDISKEKNLELYDVLLSKIKDGVYGIVYSTSLKLLTEKREKFISLSVELQVELLYNELHLFQCNRVNSDLSLLGGSPNSGIILIQKTVTDKNKEYLINQSPTSLFESAPVDLYTI

SEQ ID NO: 8550 - protein, 1366 aa, unidentified
  REGION 1..1366: note = Description of Unknown:uncultivated organism sequence
MRWMSIMKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNEHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRHWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKRQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8551 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDLGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDGNGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8552 - protein, 1350 aa, unidentified
  REGION 1..1350: note = Description of Unknown:uncultivated organism sequence
METKKKSFGEYFLGIDAGTDSVGWAVTDENYNVLKFHGKAMWGVRLFEEANPAADQRAARTARRRQGRKVQRTKLLQELFAPEISKIDPAFFIRMSDSKYHAEDKTEFQPNALFNDAGYTDKDFHKEYPTVYHLRRAFIEGKDIRDPRLLYLAVHHIINNRGHFLFEGMDLSKVTDFETPFAKLCEYLREEEYDFDLSGTDTEKLKESLKAKKGITQKKKDLYAVLGNSKGTLKSVCDLLAGSAGIKLSDLFEDKSLEEETPSKISLSDSSIEENRTALENILQDRIQLIDCLKAVYDWAVLDEILSGSPYISFAKTESYEKHKRDLALLKRTVKRLCPEKYNEMFKSPDKENNYCAYSGMCIIRGKKTEIKKRASADDFRKYTEKLLKDKDDPDVKIILKEIEAQTFMPKQRCGENSVLPYQVHKVELEKILENSEKNFPFLMSEDENGLTVKDKILKILTFRIPYYVGPLNDAHKEAGFCWIVRKNADDKEAIRPWNFEQKVDLQASAEQFINRMTNKCTYLVGEDVLPKESILYSEYSVLNELNNLRLNGEPLAAEDKTAIVDGLFRRNNKVKIKDIANYYKRTGREVKIDDFTGFHEDLKSSMRSYNAFSTIMGDRFDRDAAEEAIRAIVLFGNDQKILLQRLKGIKGGYFTEAERKQIARLKFSDWGRLSEKFLTGIYSADKETGEAFNIIEALRRTDKNLMQLLSSDYDFKKTIDAENEKINGGIPEFSYDALVKDSYASPAVKRAIWQVLTIAKEIEKITGHAPKKIFMETTREEREKKATQSRKKQLLELYKKCKDETSEYLRNSLESKEDSELRSTALYLYYTQMGKCMYSGETIELEKLFDKNVYDIDHIYPQSKTKDDSLDNKVLVKKELNGKKSDRFPIPNEVLAPGIREHWKRLRAANLISEEKYNRLTRKTFFSATELSGFIARQLVETSQSTKAAAEILQRVYPETRLVYSRASNVDKFKKRYEIVKVREVNDYHHARDAYLNIVVGNIFDVKFTTNPANFIRSGETYSLNENMYDCDVRRGNTTAWIAGNNGTLTTVKRTCSKENILFTRYAFEQKGGLFDQQIMKKGKGQLPTKPSDPHMQGQSFSAWIDKYGGYNKISGAYFCLVEHTKKGKSVRTLEFVPVYLAAEIEKCPERLEEYLTEDRGIEDPDVRIRKIKFDSLFNFNGFPMHLSGRTGERLLFKPAVQLKVPKGLYTYTKRIVKFTEREKTLRKEIVPRPADGIDKENNLALFDFLSEKLSKTLYNIAYKTQAQLTSGRKETFSNLTEREQVKTLYELLHLFQCNSMLSDLSLIGGPTHTGTLLKSKEITDNDKAEIIYQSPTGLFEHSVDLLTV

SEQ ID NO: 8553 - protein, 1330 aa, unidentified
  REGION 1..1330: note = Description of Unknown:uncultivated organism sequence
MERCGKNAAYLGLDIGSTSVGWAVSDETYRLCRVKGKDMWGVRLFEEAQTAAARRVARVQRRRYDRRNQRLALLQELFQAQIARVDPAFFQRMDAARLWSQDKPWKYTLFEQKGWTDREYHAQYPTVYHLRRALMTQDGPFDVRLVYLALHHILKKRGHFLYADLGDGQLPELEEIIRELELRFEDELGMELRCHDIDTLRPLLMDSTLSISARQKQLNAVFAAETKQQKTWVKALTGAKVKLSELYEDPTLEEAEQKEAEFRKAGYEDGLPVLEAVLGDRFALLEAWRSLYNWGVLQRLLGGASSISEAKVRQYEQNKKDLAELKAVLRADRTLYNRVFRATDVPGNYASIVGHAWVEGKKQTVKVCGHEDFCKFIEKVLDTLEQDERVQALRTRAKEGTLLPKLISGDNSVIPYQLHRAEMEQILDRAAVYLPFLKEKDVEGLTPADKIRALLVFRIPYYVGPLNPHSPNSWFVRKTEGPIYPWNFEDRVDRVRSAQAFIDRMTSSCTYLRGCDVLPACSPIYERFTVLNELNPMTVKGEPLSIELKQAIFEQVFLKIRKPGIRNIVGFLRAQGYDVSREDLGGIDVQGGVKSSLRTTLALQEILGEKYDDAKAEEIVLAATYFGDDRRLLREKLRSLGLTDDVIGRLLRLHCAGWGRLSRELLCEVTSFVPGQPDGASILDTLWQTNETLMGLLSDRYTFAEAIEARNREVGEESLYDFIDELYVSPSVKRQIRQTVLVARELRKVIGHDPKKIFIEMARGKEKKPERKPKRKQTLLACYETFQNEAGALYETLMQTDNQRLRQDKIYLYYTQMGRCMYSGERIDLEELLRSESLYDIDHIYPRSRVKDDSIDNRVLVKRTLNEKKGNDYPLSHEIVEGQRAFWSMLLYRKLISREKYERLTRRTGFTDEELTSFAARQLVETRQGTKAVAQLLGRMMPDSEIVYVKAGLVSDFRHARSLPKVRELNDLHHAKDAYLNIVVGNIYNTQFTHSPMRYICEHRDNYTVNLDSLLKMEIHRGGVLAWDPADGGSIATVRRTMARNSPLVTMMPVIYSGILFDLQPKPQGQGQMPLKKGLPIEKYGGYNKVTGACFMLVEHTLRRRRVRSLIDVPLHLYPDAVSHPELALRHCIEMRDLKEPRIILPIIRMRALLSLDGYKMYITGRTNGNLCIQNANQLMVSEEWEQYIKKIVKAARESMEYERLRGGEGYRPNPRDGLCPEKNLALYDLFVQKMERMPYCQRMSGQRDKLLQARAAFEALDVAQQCCILCQLLNLFSRVGGEADLTGIGLVKNFGILHPSGMISGCAQALLIHQSPTGLYERVVDLNRL

SEQ ID NO: 8554 - protein, 873 aa, unidentified
  REGION 1..873: note = Description of Unknown:uncultivated organism sequence
MNKDLKSIDYYIGLDCGTSSVGFAVTDTNYNILKFNGKRMWGSHLFEEANTAAGRRGFRTARRRLERRRKRILLLQEIFAEEICKVDPTFFIRLNDSKYILEDKTTPDLNILFNDKNYKDKDFFKIYPTAYHLRKALMTEDIKDPRLLYLGIQHILKNRGHFLFPGEGMKAVESIKPLVDDIQNVFEELFDDATFEYTSIGKLQEALMSKRNSEKKEKLEKEILISDTKLKASVVRILLGYKVKTTTLFKKEGDEIPDVEFKKASFEESDLPELQDRLSDEEFAFIKAAKGIYDWTLLASIMSGHLYISDAKIELFDSNKADLKHLKEAIKTYAPDKYESFFHSDEKGSYSSYTGKIHGDHVVKRVKRTGTDEFYKKIKNLLEKVPKDDEHVKHILDAIENDSFMPLLKSFRNGTIPYQMNKIELDAILANCSKNFEFLEKKDPDGFSATEKIKELLKFRVPYYVGPLGSNPYGKETKGKNSWVERKTSGRVLPWNIEQKIDYESSAEKFIERMTNKCTYCKDQDVLPKNSLEYSKYMVLNELNNLRICGDRLSVPRKQEIFNELFKKEKKVSISKLTKYINDNCWYSGKIKKEDITGIDGDLKASLSSYFDFKDFLESHRLKADDVDRIIKWATVFSEGGDMLRKRIEREFGEVLTKEEIDKTSKLKYAGWGRFSHKFLYEIQAINKENGELMSVMRMLWETQNNLMELLSNKYEFIEQITKPKTIGKLDYSIVDEMYVSPAVKKETWQTLRIVDELIRIMGHNPQKVFVEVTRSEQEKKRTVSRKQTLIDTLKDATKTDSNYINELRELISKLEEKSESEVSRQDKLYLYFSQCGKCMYTGERIDIEDLYNTKHNMTLTTYSHNQEQTMTL

SEQ ID NO: 8555 - protein, 1378 aa, unidentified
  REGION 1..1378: note = Description of Unknown:uncultivated organism sequence
MKEIKKIFIGLDMGTNSVGWTATDENYEVIKKNGKALWGIRLFDEAQTAEDRRMHRIARRRIERRSRRIDLLQELFAQEICKKDPGFYERLNESGLHEEDKRVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAVGGTASLSDIFNDEKLKDFEKNKVNFSSAQFEENEPDIMAELGDRYDLIAALHGLYNWSLLAELMGEHHYISEAKIAVYDKHKADLKVLKRVLKQSPKAYAEIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVRDQYGTVSDKIISLFTFRIPYYVGPINEHANSCWVVKKDKQGKVYPWNFTEKINVEKSAEGFIRNLTNKCTYLIGEDVLPKNSLLYSEFTVLNELNNVRIGETMQKLPLRLKEKVMDNLFSRHKHVSRTKFIKYLVSEGIDKKEAESISGLDGDFKSSLSSLIDMKHILGNDFSREDAEKMIKDITIFGGDKKMLKNRLHREFSYLTPEQLTSLTRLSYDGWGRLSREFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTTSLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPAYSLNTEALYGHKVSRSGVDAWIPAEKDKKGQVMAGHEGTMGTVRKWMRKNNILFTRMPLEGKGGLFDQNIMKKGKGQVPLKGDSPVSDIGKYGGYNKASIAYMMLVQAEEKGKPVYLLESIPNYVKNKLISDKERQAYCVRTWTAQGNKYRNPQILIPKIRIQSLFEIDGFKVHISGKTGNLFVMRNAQELCMDNALAGVLKNVLKFIHRKTVQKDAAITEYDGVSDDNTLALYDFFVDKLSSSIYGKKFATQADFLRQSKDKFMNLPLEERCEVLGSILHLFQCNAVLSDFHLLGGSRQAGRIYLNKKIKVQDHVYLIEQSVTGFFEKRILLAPFGEK

SEQ ID NO: 8556 - protein, 839 aa, unidentified
  REGION 1..839: note = Description of Unknown:uncultivated organism sequence
MDRVSSAQAFIDRMTSSCTYLCGCDVLPACSPIYERFTVLNELNPMTVKGEPLSIELKQALYEQVFLKIRKPGIRNIVGFLRAQGCDVSREDLGGIDVQGGVKSSLRTTLALREILGEKYDDAQAEEIVLAATYFGDDRRLLREKLRSLGLTDDVIGRLLRLHCAGWGRLSRELLCEVTSFAPGQPDGVSILEALWQTNETLMGLLSDCYAFAEAIEERNREVGEESLYDFIDELYVSPSVKRQIRQTVLVARELRKVIGHDPKKIFIEMARGKEKKPERKPERKQTLLACYETFWDEAGALYETLMQTDNQRLRQDKIYLYYTQMGRCMCSGERIDLEELLRSESLYDIDHIYPRSRVKDDSIDNRVLVKRTLNEKKGNDYPLSHEIVEGQRAFWSMLLYRKLISRVKYERLTRRTGFTDEELTSFAARQLVETRQGTKAVAQLLGRMMPDSEIVYVKAGLVSDFRHARSLPKVRELNDLHHAKDAYLNIVVGNIYNTQFTHSPMRYICEHRDNYTVNLDSLLKMEIHRGGVLAWDPADGGSIATVRRTMARNSPLVTMMPVIYSGILFDLQPKPQGQGQMPLKKGLPIEKYGRYNKVTGACFMLVKHTLRRRRVRSLIDVPLHLYPDAVSHPELALRHCIEMRDLKEPRIILPIIRMRALLSLDGYKMYITGRTNDNLCIQNANQLMVSEEWEQYIKKIVKAARESMEYERLRGGDGYRPNPRDGLCPEKNLALYDLFVQKMERMPYCQRMSGQRDKLLQARAAFEALDVAQQCCILCQLLNLFSRSGERVDLTSIGLVKNFGVLYPSGTISGCKRALLIHQSPTGLYERVIDLNRL

SEQ ID NO: 8557 - protein, 1382 aa, unidentified
  REGION 1..1382: note = Description of Unknown:uncultivated organism sequence
MKEIRNYFIGLDMGTTSVGWAATDENYEIIKKNGKALWGIRLFDEAQTAADRRMHRIARRRIDRRSRRIDLLQELFAQEICKKDPGFYERLNESGLYEEDKTVHQKNSLFNDVDFDDKAYYKEYPTIYHLRYDLMTKDRPFDVRLVYLAVHHILKHRGHFLFDHFQVDENGVSGFEESFAAFGDAFAHIKGESFDMGKEEEMKALCRDKKLGVRHKALALAQCLGRSKDKDFKAMMTLAAGGTALLSEVFKDEGLKDFSKNKVSFSDSQFENDKPEIIAELGDRYDLIAALHGLYNWSFLAELMRGHKYISEAKIEIYDKHKEDLALLKKVLKQDRSVYNLMFKEPGDKKPINYSAYVKACKTNGKKLPLPYGKFKYEEFIKTVKFCLKNLPDSPDKKNIENKLEEGSFLLKAVSVENGAIPYQLHLQELKIILSKAEAYLPFLKVRDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGETMQKLPIRLKEKVMDNLFRRHKHVSRTKFIKYLVSEGIDKKEAESISGLDRDFKSSMSSLIDLTNILGNDFSREDGEQMIKDITIFGGDRKMLKSRLHREFPYLTPEQLTRLIHLSYQGWGRLSKELLVNLLPAEKSAGEVLVDKGSGEVLNIISAMEQTSYNLMELLSSRFGYAKAIEERNREKEGNGTISYQDVEDMYISPAVKRPLWQALKIVREIVKILGKEPSKIFIEMARENGEKGKRTISRKARLQELYKKCRDDSRDWAKELEGKSEEDFRSDRLYLYYTQMGRSMYTGKPIDINQLFDRNVYDIDHIYPQSLTGDDSLDNRVLVEKTVNAKKGDTYPLGSALDGCHIGGQIHIQDIQKEMRPFWRMLLEKGLISKEKYNRLLRTTPLSDTEKAAFIGRQLVETRQSTKACAELLSKAYPETRIVYTKAGNASRFRQYGGFIKVRDMNDYHHAKDAYLNIVVGNVFDTRFTSNPLHFLKGNHPVYSLNTEALYGHKVSRGGVDAWIPAEKDDEGHIMAGHEGTMGTVRKWMRKNNILFTRMPLEGKGGLFDQTIMKKGKGQVPLKGDSPVSDIEKYGGYNKASSAYFVLTSSKLKDETIYTIETIPLIIKRMIQTNKDKEDYIKRHWKDHGKKMVNPHICYGHIPVQSLLEINGFKVHLTGKSGKDFKLRNAEQLCISNDDAAVLKRVLKYNERSSSSKGKEALLITPFDNIQEVDLNRLYQVFEDKLTNQVYKVKLGKQASVLKKGEDKFNELPLEVKCRVIGEILHLFQCNAAIADLRLIGGAKNAGALTMNPRVSPEDHVYLIEQSVTGFFEKRILLAPYGEK

SEQ ID NO: 8558 - protein, 1393 aa, unidentified
  REGION 1..1393: note = Description of Unknown:uncultivated organism sequence
MMKEIKNYFIGLDMGTTSVGWAATDENYEIIKKNGKALWGIRLFDEAQTAEDRRMHRIARRRIERRSRRIDLLQELFAQEICKKDPGFYERLNQSGLHEEDKKVHQPNSLFNDVDFNDKAYHKKYPTIYHLRHALMTENHPFDVRLVYLAIHHILKHRGHFLFENFQVDENGVSGFEESFAAFGNALEHIKGESLDMGKEEEMKALCKDKKLGVKHKALALAQCLGRSKDNDFKDMMSLAAGGQATLSKIFKDEGLKDFSKNKVSFSDSQFENDKPEIIAKLGDRYDLIAALHDLYNWSFLAELMRGHKYISEAKIAIYDKHKEDLALLKKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSVENGAIPYQLHLQELKIILSKAEAYLPFLKVRDQYGTVSDKIISLFTFRIPYYVGPINEHAGSCWVVKKDKHGKVYPWNFTEKIDIEKSAEGFIRNLTNKCTYLIGEDVLPKNSLLYSEFTVLNELNNVRIGETMQKLPLSLKEKVMDHLFSCYKHVSRTKFIKYLVSEGIDKKEAESISGLDGDFKNSLSSLIDMKHILGNDFSREDAEKIIKDITIFGGDKKMLKNRLQREFSYLTPEQLTSLTQLSYDGWGRLSKEFLVNLLPAEGNSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCKDDTRDWTKELKGKPEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFSTRFTANPLNFLKGNHQAYSLNTEALYGHKVSRNGVDAWIPAEKDEKGQVMAGHEGTMGTVRKWMRKNNILFTRMPYEGKGGLFDQNIMKKEKGQVPIKGDSPISNIKKYGGYNKAKVAYFVLTQSKLNKKTVYTLEAIPLILKNSIQSNKDKETYIQKQWRKNGKKMEHPIVCLGHIPVQSLLEINGFKVHLSGKNGKDILLRNAEQLCINEADTAVLKKILKFNQRAAMSKKGEEIFINSFDNIQEEDLNRLYHVFEDKLTNQIYKVKLGKQAAVLKKGEETFNRLSPEQKCKLIGEILHLCQCKATHADLRLIGGAKKAGILTMGTQIYPKDHVYLIEQSVTGFFEKRILLAPFGEK

SEQ ID NO: 8559 - protein, 1345 aa, unidentified
  REGION 1..1345: note = Description of Unknown:uncultivated organism sequence
MKNEKKSFGEYYLGIDAGTDSVGWAVTDGNYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVVDFETPFSVLKEYLREEDFGFDFSNIDADALKESLKTKQGITQKKKDLYKLLGKEKGTLKSVCDLLAGGSGIKLTDLFNDESLAGETPEKISLADSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGCCWIVRKNTEDTSRILPWEFEQKVDLYASAEQFINRMTNKCTYLVGEDVLPKDSLLYSKYSVLNELNNLKLNGEPLKQEDKENIIKEIYEKKNKVKIKDIANYYKRNGFDVKPDDFTGFHEELKSSLRSYNLFFSLRGEKLDESAVEEAIRAVVLFGNDKKMLSQRLRNIKNGFFSETEINRISGFKFSDWGRLSKKLLTGIKETGETFNIIEALRVTNKNLMQLLSSEFDFKKKIDEENEKINGGIPEFSYDTLVKDSYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRSAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGNNVAWVAGNNGTIATVKKTCSKENILFTRYAFEQKGGLFDQQIMKKGKGQLPTKPSDPHMQGQTEQEWIDKYGGYNKLSGAYFCLVEYKDKGKTVRSIESVPLLVSAKIKNDPSELEKYLKQALGTEELSVRIREIKFNTLFNHNGFLMHITGRTGDQLVFKPALQLKVNASDYAYIKKIVRFCEREKESKKAFTVSGFDGIEKDRNIELFDFFTKKLSSDIFMVHHEPTLKSLLANRNIFVDMSVEMQARTIYQILHIFRCNRMLADLTALQGAKSAGIVRMSKRISSKDKTMIINQSPTGLFENSVDLLTV

SEQ ID NO: 8560 - protein, 1360 aa, unidentified
  REGION 1..1360: note = Description of Unknown:uncultivated organism sequence
MKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWPRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8561 - protein, 1330 aa, unidentified
  REGION 1..1330: note = Description of Unknown:uncultivated organism sequence
MERCGKNAAYLGLDIGSTSVGWAVSDETYRLCRVKGKDMWGVRLFEEAQTAAARRVARVPRRRYDRRNQRLALLQELFQAQIARVDPAFFQRMDAARLWSQDKPWKYTLFEQKGWTDREYHAQYPTVYHLRRALMTQDGPFDVRLVYLALHHILKKRGHFLYADLGDGQLPELEEIIRELELRFEDELGMELRCHDIDTLRPLLMGSTLSISARQKQLNTVFAAETKQQKTWVKALTGAKVKLSELYEDPTLEEAEQKEAEFRKAGYEDGLPVLEAVLGDRFALLEAWRSLYNWGVLQRLLGGASSISEAKVRQYEQNKKDLAELKAVLRADRTLYNRVFRATDVSGNYASIVGHAWVEGKKQTVKVCGHEDFCKFIEKVLDTLEQDERVQALRTRAKEGTLLPKLISGDNSVIPYQLHRAEMEQILDRAAVYLPFLKEKDAKGLTPADKIRALLVFRIPYYVGPLNPHSPNSWFVRKTEGPIYPWNFEDRVDRVRSAQAFIDRMTSFCTYLRGCDVLPACSPIYERFTVLNELNPMTVKGEPLSIELKQAIFEQVFLKIRKPGIRNIVGFLRAQGYDVSREDLGGIDVQGGVKSSLRTTLALQEILGEKYDDAKAEEIVLAATYFGDDRRLLREKLRSLGLTDDVIGRLLRLHCAGWGRLSRELLCEVTSFVPGQPDGASILDTLWKTNETLMGLLSDRYMFAEAIEARNREVGEESLYDFIDELYVSPSVKRQIRQTVLVARELRKVIGHDPKKIFIEMARGKEKKPERKPKRKQTLLACYETFQNEAGALYETLMQTDNQRLRQDKIYLYYTQMGRCMYSGERIDLEELLRSESLYDIDHIYPRSRVKDDSIDNRVLVKRTLNEKKGNDYPLSHEIVEGQRAFWSMLLYRKLISREKYERLTRRTGFTDEELTSFAARQLVETRQGTKAVAQLLGRMMPDSEIVYVKAGLVSDFRHARSLPKVRELNDLHHAKDAYLNIVVGNIYNTQFTHSPMRYICEHRDNYTVNLDSLLKMEIHRGGVLAWDPADGGSIATVRRTMARNSPLVTMMPVIYSGILFDLQPKPQGQGQMPLKKGLPIEKYGGYNKVTGACFMLVEHTLRRRRVRSLIDVPLHLYPDAVSHPELALRHCIEMRDLKEPRIILPIIRMRALLSLDGYKMYITGRTNGNLCIQNANQLMVSEEWEQYIKKIVKAARESMEYERLRGGEGYRPNPRDGLCSEKNLALYDLFVQKMERMPYCQRMSGQRDKLLQARAAFEALDVAQQCCILCQLLNLFSRVGGEADLTGIGLVKNFGILHPSGMISGCAQALLIHQSPTGLYERVVDLNRL

SEQ ID NO: 8562 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQEDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLIQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8563 - protein, 1392 aa, unidentified
  REGION 1..1392: note = Description of Unknown:uncultivated organism sequence
MKEIKKIFIGLDMGTTSVGWAVTDENYEIIKKNGKALWGIRLFDEAQTAEDRRMHRIARRRIERRSRRIDLLQELFAQEICKKDPGFYQRLNESGLHEEDKSIRQANSLFNDDDYDDKAYHKKYPTIYHLRHALMTENHPFDVRLVYLAIHHILKHRGHFLFENFQVDENGVSGFEESFAAFGNALEHIKGESLDMGKEEEMKALCKDKKLGVKHKALALAQCLGRSKDNDFKDMMSLAAGGQATLSKIFKDEGLKDFSKNKVSFSDSQFENDKPEIIAKLGDRYDLIAALHDLYNWSFLAELMRGHKYISEAKIEIYDKHKEDLALLKKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSVENGAIPYQLHLQELKIILSKAEAYLPFLKVKDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGETMQKLPLRLKEKVMDNLFSRHKHVSRTKFIKYLVSEGIDKKEAESISGLDGDFKSSLSSLIDMKHILGNDFSREDAEKMIQDITIFGGDKKMLKNRLHREFSYLTPEQLTSLTRLSYDGWGRLSREFLVHLLPADGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTEALYGHKVSRNGVDAWIPAEKDEKGQVIDGHEGTMGTVRKWMRKNNILFTRMPLEGKGGIFDQNIMKKGKGQVPLKGDSPVSDIGKYGGYNKAKAAYFVLTQSKLNENTVYTLETIPLILRNNIQSNKDKETYIQKQWKKNGTKMEHPLVCLGHIPVQSLLEINGFKAHLSGKNGKTFSLRNAEQLCINEADTAVLKKILKFNQRAVLSKKGEEISINPFDNIQEEDLNRLYHVFEDKLTNQIYKVKLGKQAAVLKKGEETFNRLSPEQKCKLIGEILHLCQCNATNADLRLIGGAKNAGALTMSTQIYPKDHVYLIEQSVTGFFEKRILLAPFGEK

SEQ ID NO: 8564 - protein, 1380 aa, unidentified
  REGION 1..1380: note = Description of Unknown:uncultivated organism sequence
MKELKNYFVGLDMGTTSVGWAVTDENDEIIKKNGKALWGIRLFEEAETAADRRMHRISRRRIERRSRRIDLLQELFAQEICKKDPGFYERLNESGLYEEDKTVHQPNSLFNDVDFNDKAYHKTYPTIYHLRNALMTENRVFDVRLVYLAIHHILKHRGHFLFDNFQVDENGASGFEESFGAFGNALDRIKGDSLDVSKEDAMKAVCRDKKLGVKQKAAALGQCLGRGKDKAFKAMMTLAAGGTASLSDVFEDDGLKDFDKNKVNFSSIQFEENEPDIMAELGDRYDLIAALQGLYSWSLLAELMGDHKYISEAKIELYEKHGKDLKVLKRVLKQSPIDYAHMFKAQGSKKNTNYSAYVGVCKIKGKKVPVEKCGYEDFAKTVKSCLKNLPDSEDKKYIEKELEQGTFLPKAVSKENGVIPYQLHLQELKKILSSAEAYLPFLKEKDKYGTVSDKIISLFTFRIPYYVGPTNEHAKSCWVVKKDKTGKIYPWNFTEKIDVEKTAEGFIRNLTNKCTYLIGEDVLPKNSLLYTEFMVLNELNNVRIGQTMQKLSPELKEKILENLFRKHKHVARKRFINYLAAEGMDRKEAESISGLDGDFKSSLSSFIDMKGILGKDFKREDVERMITDITIFSGDKKMLRTRLHREFSYLSPKQLTSITRLSYEGWGRLSKELLVNLFPAEGDAYEVLADKTSGEVLNIISAMEQTSFNLMELLSSRFGYAKAIEERNREKEGNGTISYRDVEDMYISPAVKRPLWQALKIVREIVKILGKEPSKIFIEMARENGEKGRRTVSRKARLQELYKKCRDDSRDWAKELEERPEEDFRSDRLYLYYTQMGRSMYTGKPIDINQLFDRNVYDIDHIYPQSLTGDDSLDNRVLVEKTVNAKKGDTYPLGRALDGCHIGGQIHIQDIQKEMRPFWHMLYEKEFISKEKYNRLSRTIPLTDTEKAAFIGRQLVETRQSTKACAELLSKAYPDTRIVYTKAGNASRFRQYGGFIKVRDMNDYHHAKDAYLNIVVGNVFDTRFTSNPIRFLKGNHPVYSLNVEALYGHRVGRGGVDAWIPAEKDEEGHTCPGHEGTMGTVRKWMKKNNILFTRMPFEGKGGFFDQNIMKKGKGQVPLKENSPVSDIEKYGGYNKASSAYFVLTSSKLKNETIYTIETIPLIIKRMIQTNKDKEDYIKQHWKDHGKKMVNPHICYGHIPVQSLLEINGFKVHLTGKSGKDFKLRNAEQLCISNDDAAVLKRVLKYNERSSSSKGKEALLITPFDNIQEVDLNRLYQVFEDKLTNQVYKVKLGKQASVLKKGEGKFNELPLEVKCRVIGEILHLFQCNAAIADLRLIGGAKNAGALTMNPRVSSEDHVYLIEQSVTGFFEKRILLAPYGEK

SEQ ID NO: 8565 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEKFISRMTNKCTYLVKKDVLPKNSLLYTEFMVLNELNNVRIGSAQEKLPPGMKDRVWENLFLKDKKITAKKLCSYLIREEHIPKEEAAQISGIERDFKASLAPWIDMRKILGNNFIISDSEKIIKDITLFGADKKMLRRRLKARFGYLKDCQVKELVRLPYQGWGRLSKEFLTQILPKAERDTTVLVDQETGEVMNIITALKKTDHNLMELLSGKFGYSAALSEVNTTSVSVCDKAISYKNIQDMRISPAVKRPLWQTLRIIKEIIHIMGKAPSRIFIEMARAEDEKKRKTVSRKDRLLDLYKKCNDEIRHWSEDIKKLGEEIKELSDGQLRSDKLYLYYTQMGRSMYTGKPICLGSLMDGADYDIDHIYPRSATGDDSLDNRVLVEKTENAKKGDHYPLSVEIQRERADFWKILLDKGLISKEKYHRLTRKTLLTDDEKAGFIGRQLVETRQSTKAVAEILKKAFPETKIIYTKARNVSRFRQYAEFVKVRDMNDYHHAKDAYLNIVVGNAFYTKFTSNPVHFLSEKNAVYSLNEKAFYQFPIQRGSTTAWEPGDNGTMAVVRKWMDKNNILYTRMPFEEKGGLFDQNIRKKGKGQVSLKAQGALSDIQKYGGYNKATASYFMLVKAEKNGKRIYLLETVPLHLSERLESIDDKIDFCRELWHKEGKGYKNPVICIPKIYKQSLFEVDGFREHISAKTGDRFVMRNAEQLCLNAESAQIIKNVLKFNQRKQVQKELKVTVHDKITEENLINIFETFISKIQTSIYRNKFKKFVSLMIKEKGTFIELSMEDKCKCIGEILHLFQCNPVLSNLQLIGGEKASGKISMGKKFDGNEKVFLILQSVTGFFEKKILLAPYEKK

SEQ ID NO: 8566 - protein, 1387 aa, unidentified
  REGION 1..1387: note = Description of Unknown:uncultivated organism sequence
MKEIKKIFIGLDMGTNSVGWTATDENYEVIKKNGKALWGIRLFDEAQTAEDRRMHRIARRRIERRSRRIDLLQELFAQEICKKDPGFYERLNESGLHEEDKSIRQANSLFNDDDYDDKAYHKKYPTIYHLRHALMTENHPFDVRLVYLAIHHILKHRGHFLFENFQTDEKGTSGFDESFAAFGSALERIKGCSPDVRKADSVKDILKDKKLGVTEKAASLLQCLGQGKEKDFKAMMTLAAGGTASLSNIFNDEKLKDFEKNKVNFSSAQFEENEPDIMAELGDRYDLIAALHGLYNWSLLAELMGEHRYISEAKIAVYDKHKADLKVLKRVLKQSPKAYAKIFREPGSNANKNYGAYVGVCKVKGKKEAKEALEKFEKCSYEEFTKTLKPFLKEMPDNNDKDYISRELNMGTFLPKSVSKENGVIPYQLHLQELKIILSKAEAYLPFLKVKDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVKIGETMQKLPLSLKEKVMDNLFSCYKHVSRTKFIKYLVSEGIDKKEAESISGLDGDFKSSLSSLIDMKHILENDFSREDAEKMIQDITIFGGDKKMLKNRLHRKFSYLTPEQLTSLTRLSYDGWGRLSREFLVNLLPAEGDSCEVLVDHTSGEVLNIISAMRQTSYNLMELLGSSFGYGQAIEERNRKEEGQGRITYKDVEDLYISPAVRRPLWQALKIVREIVKITGKEPSKIFIEMARENGEKGKRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTEALYGHKVSRSGVDAWIPAEKDEKGQVMAGHEGTMGTVRKWMRKNNILFTRMPLEGKGGLFDQNIMKKGKGQVPLKGDSPISNIEKYGGYNKAKAAYFVLTQSKLNENTVYTLETIPLILKSSIQSNKDKEIYIQKQWKKNGKKMEHPIVCLGHIPVQSLLEINGFKVHLSGKNGKDFLLRNAEQLCINEADAAVLKKILKFNQRASLSKKGEEISINSFDNIQEEDLNRLYHVFEDKLTNKIYKVKLGKQAAVLKKGEEMFNRLSPEQKCKLIGEILHLCQCNAKHADLRLIGGAKNAGALTMTTQIYPKDYAYLIEQSVTGFFEKRILLAPFGEK

SEQ ID NO: 8567 - protein, 1360 aa, unidentified
  REGION 1..1360: note = Description of Unknown:uncultivated organism sequence
MKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKIIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8568 - protein, 1349 aa, unidentified
  REGION 1..1349: note = Description of Unknown:uncultivated organism sequence
MKNEKKSFGEYYLGIDAGTDSVGWAVTDENYNVLKFHGKAMWGVRLFEEAQTAADRRALRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVVDFETPFSVLKEYLLEEDFGFDFSNIDADALKESLKTKQGITQKKKDLYKLLGKEKGTLKSVCDLLAGGSGIKLTDLFNDESLAGETPEKISLADSSIEDDRTALENILQDRIQLLDCLKAVYDWAILDEILSGSPYISFAKTQSYEKHKKDLALLKKTIKRLCPEKYKEVFKSPNTASNYCAYSGMCVINGKKTAIEKRTTASDFGKYIAKLLSSFDDPDAKDILRQIDAQTFMPKQRTGENSVLPYQVHKVELEKILGNAERNFPFLLKKDDSNLTVKDKIIKLLTFRIPYYVGPLNDKHRNSGFCWIVRKNTEDTSRILPWEFEQKVDLYASAEQFINRMTNKCSYLVGEDVLPKDSLLYSEYSVLNELNNLKLNGESLEQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTVIYSVNKETGEAFNIIEALRTTDKNLMQLLSAEFDFKKQIYEENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGSNVAWVAGNNGTIATVKKTCSKENILFTRYAFEQKGGLFDQQIMKKGKGQLPTKPSDPHMQGQTEQEWIDKYGGYNKLSGAYFCLVEYKDKGKIVRSIESVPLLVSAKIKNDPSDLEKYLKQALGTEELSVRIREIKFNTLFNHNGFLMHITGRQGNQLIFKPALQLKVNASDYAYIKKIVRFCEREKESKKAFTVSGFDGIEKDRNIELFDFFTKKLSSDIFMVHHAATLKSLLANRSIFVDMSVEMQARTIYQILHIFRCNRMLADLTALQGAKSAGTVLMSKKISLNDKIMIINQSPTGLFENSVDLLTV

SEQ ID NO: 8569 - protein, 1381 aa, unidentified
  REGION 1..1381: note = Description of Unknown:uncultivated organism sequence
MKEIKKIFIGLDMGTNSVGWTATDENYEVIKKNGKALWGIRLFDEAQTAEDRRMHRIARRRIERRSRRIDLLQELFAQEICKKDPGFYERLNESGLYEEDKRVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAAGGTASLSDIFNDEKLKDFEKNKVNFSSAQFEENEPDIMAELGDRYDLIAALHGLYNWSLLAELMGEYHYISEAKIAVYDKHKADLKVLKRVLKQRPDIYAKIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVRDQYGTVSDKIISLFTFRIPYYVGPINEHANSCWVVKKDKQGKVYPWNFTEKIDVEKSAEGFIRNLTNKCTYLIGEDVLPKNSLLYSEFTVLNELNNVRIGETMQKLPLRLKEKVMDNLFSRHKHVSRTKFIKYLVSEGIDKKEAESISGLDGDFKSSLSSLIDMKHILGNDFSREDAEKMIQDITIFGGDKKMLKDRLHREFSYLTPEQLTSLTRLSYDGWGRLSREFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTETLYGHKVSRNGVDAWIPAEKDEKGQVIDGHEGTMGTVRKWMRKNNILFTRMPLEGKGGLFDQNIMKKGKGQVPLKGDSPVSDIGKYGGYNKAKAAYFVLTQSKLNENTVYTLETIPLILRNNIQSNKDKETYIQKQWKKNGTKMEHPLVCLGHIPVQSLLEINGFKAHLSGKNGKTFSLRNAEQLCINEADTAVLKKILKFNQRAVLSKKGEEISINPFDNIQEEDLNRLYHVFEDKLTNQIYKVKLGKQAAVLKKGEETFNRLSPEQKCKLIGEILHLCQCNATNADLRLIGGAKNAGALTMSTQIYPKDHVYLIEQSVTGFFEKRILLAPFGEK

SEQ ID NO: 8570 - protein, 990 aa, unidentified
  REGION 1..990: note = Description of Unknown:uncultivated organism sequence
MYTRGFCRGNKKIIKNFPDSEDKKYILDKIERNELLPKAVSKQNGVIPYQLHLVELNKILSNAERYLPFLKKEDEYGTVSDKIRKLFTFRIPYYVGPLNGHSSFAWAVRKDENGHIYPWNFERKIDIEASAEEFIRRMTNKCTYLVKKDVLPKNSLLYTEFMVLNELNNVRIGSAQEKLPPGMKVRVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMHISPAVKRPLWQTLRVIKEIIHIMGKAPSRIFIEMARAEDEKKWKTVSRKDRLLDLYKKCKDEIRNWSADIKKLGEEIEELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8571 - protein, 1363 aa, unidentified
  REGION 1..1363: note = Description of Unknown:uncultivated organism sequence
MSIMKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKTVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKRKTVSRKDRLLDLYKKCNDEIRHWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMNKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8572 - protein, 1345 aa, unidentified
  REGION 1..1345: note = Description of Unknown:uncultivated organism sequence
MKNEKKSFGEYYLGIDAGTDSVGWAVTDGNYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVVDFETPFSVLKEYLREEDFGFDFSNIDADALKESLKTKQGITQKKKDLYKLLGKEKGTLKSVCDLLAGGSGIKLTDLFNDESLAGETPEKISLADSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCTYLVGEDVLPKDSLLYSKYSVLNELNNLKLNGEPLKQEDKENIIKEIYEKKNKVKIKDIANYYKRNGFDVKPDDFTGFHEELKSSLRSYNLFFSLRGEKLDESAVEEAIRAVVLFGNDKKMLSQRLRNIKNGFFSETEINRISGFKFSDWGRLSKKLLTGIKETGETFNIIEALRVTNKNLMQLLSSEFDFKKKIDEENEKINGGIPEFSYDALVKDSYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRSAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGNNVALVAGNNGTIATVKKTCSKENILFTRYAFEQKGGLFDQQIMKKGKGQLPTKPSDPHMQGQTEQEWIDKYGGYNKLSGAYFCLVEYKDKGKTVRSIESVPLLVSAKIKNDPSELEKYLKQALGTEELSVRIREIKFNTLFNHNGFLMHITGRTGDQLVFKPALQLKANASDYAYIKKIVRFCEREKESKKAFTVSGFDGIEKDRNIELFDFFTKKLSSDIFMVHHEPTLKSLLANRNIFVDMSVEMQARTIYQILHIFRCNRMLADLTALQGAKSAGIVRMSKRISSKDKTMIINQSPTGLFENSVDLLTV

SEQ ID NO: 8573 - protein, 1329 aa, unidentified
  REGION 1..1329: note = Description of Unknown:uncultivated organism sequence
MCCGKNAVYLGLDIGSASVGWAVSDETYRLCRFKGKDMWGVRLFGEAQTAAKRRVARVQRRRYDRRNQRLALLQELFQAQIAQVDPAFFQRMDAARLWPDDKPWKYTLFEQEGWTDREYYARYPTVYHLRRALMTQDGPFDVRLVYLALHHILKKRGHFLYADLGDGQLPALEEIMRELELRFEDELSMELRCHDIDALRPLLMDSTLSISARQRQLNVVFAAETRQQKTWVKALTGAKVKLSELYEDPTLEEAEQKEAEFRKAGYEDGLPVLEAVLGDRFALLEAWRSLYNWGVLQRLLGGASSISEAKVRQYEHNKKDLAELKAVLRADRTLYNRVFRATDMPGNYASLVGHAWVEGKKQTVKVCRHEDFCKFIEKVLDTLEQDERVQALRTRAKERTLLPKLISGDNSVIPYQLHRAEMDQILDRAAVYLPFLKEKDAEGLTPADKIRALLVFRTPYYVGPLNPHSPNSWFVRKTEGPIYPWNFEDRVDRVSSAQAFIDRMTSSCTYLRGCDVLPACSPIYERFTVLNELNPMTVKGEPLSIELKQALYEQVFLKIRKPGIRNIVGFLRAQGCDVSREDLGGIDVQGGVKSSLRTTLALREILGEKYDDAQAEEIVLAATYFGDDRRLLREKLRSLGLTDDVIGRLLRLHCAGWGRLSRELLCEVTSFAPGQPDGASILDALWQTNETLMGLLSDRYTFAEAIEARNREVGEESLYEFIDELYVSPSVKRQIRQTVLVARELRKVIGHDPKKIFIEMARGKGKKPERKPERKQTLLACYETFRDEAGVLYNALQQTDNQRLRQDKIYLYYTQMGRCMYSGEHIDLEELLRSESLYDIDHIYPRSRVKDDSIDNRVLVKRTLNEKKGNDYPLSHEIVEAQKAFWSMLLHRNLISREKYQRLTRRTGFTDEELTSFAARQLVETRQGTKAVAQLLGRMMPNSEIVYVKAGLVSDFRHVRSLPKVRELNDLHHAKDAYLNIVVGNIYNTQFTHSPMRYIREHRDNYTINLDSLLKMEIRRGGMLAWNPADGGSIATVRRTMARNSPLVTMMPVIYSGILFDLQPKPQGQGQMPLKKGLSIEKYGGYNKVTGACFMLVEHTLRRRRVRSLIDVPLHLYPDAVSHPELALRHCIEMRDLKEPRIILPIIRMRALLSLDGYKMYITGRTNDNLCIQNANQLMVSEEWEQYIKKIVKAARESMEYERLRGGDGYRPNPRDGLCLEKNLELYNLFVQKMERMPYCQRMSGQRDKLLQARAAFEALDVAQQCCILCQILNLFSREGGEADLTGIGLVKNFGILHPSGMISGCAQALLIHQSPTGLYERVVDLNRL

SEQ ID NO: 8574 - protein, 1393 aa, unidentified
  REGION 1..1393: note = Description of Unknown:uncultivated organism sequence
MMKEIKKIFIGLDMGTTSVGWAVTDENYEIIKKNGKALWGIRLFDEAQTAEDRRMHRIARRRIERRSRRIDLLQELFAQEICKKDPGFYERLNESGLHEEDKKVHQPNSLFNDVDFNDKAYHKKYPTIYHLRHALMTENHPFDVRLVYLAIHHILKHRGHFLFENFQVDENGVSGFEESFAAFGNALEHIKGESFDMGKEEEMKALCKDKKLGVKHKALALAQCLGRSKDNDFKDMMSLAAGGQATLSKIFKDEGLKDFSKNKVSFSDSQFENDKPEIIAKLGDRYDLIAALHDLYNWSFLAELMRGHKYISEAKIEIYDKHKEDLALLKKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSVENGAIPYQLHLQELKIILSKAEAYLPFLKVRDQYGTVSDKIISLFTFRIPYYVGPINEHAGSCWVVKKDKHGKVYPWNFTEKIDIEKSAEGFIRNLTNKCTYLIGEDVLPKNSLLYSEFTVLNELNNVRIGETMQKLPLSLKEKVMDHLFSRYKHVSRTKFIKYLVSEGIDKKEAESISGLDGDFKNSLSSLIDMKHILGNDFSREDAEKIIKDITIFGGDKKMLKNRLQREFSYLTPEQLTSLTQLSYDGWGRLSKEFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCKDDTRDWTKELKGKPEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFNTRFTANPLYFLKGNHQAYSLNTEALYGHKVSRNGVDAWIPAEKDEKGQVMAGHEGTMGTVRKWMRKNNILFTRMPYEGKGGLFDQNIMKKEKGQVPIKGDSPISNIKKYGGYNKAKAAYFVLTQSKLNKKTVYTLEAIPLILKNSIQSNKDKETYIQKQWRKNGKKMEHPIVCLGHIPVQSLLEINGFKVHLSGKNGKDILLRNAEQLCINEADTAVLKKILKFNQRAAMSKKGEEIFINSFDNIQEEDLNRLYHVFEDKLTNQIYKVKLGKQAAVLKKGEETFNRLSPEQKCKLIGEILHLCQCKATHADLRLIGGAKKAGILTMGTQIYPKDHVYLIEQSVTGFFEKRILLAPFGEK

SEQ ID NO: 8575 - protein, 1345 aa, unidentified
  REGION 1..1345: note = Description of Unknown:uncultivated organism sequence
MKNEKKSFGEYYLGIDAGTDSVGWAVTDGNYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVVDFETPFSVLKEYLREEDFGFDFSNIDADALKESLKTKQGITQKKKDLYKLLGKEKGTLKSVCDLLAGGSGIKLTDLFNDESLAGETPEKISLADSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCTYLVGEDVLPKDSLLYSKYSVLNELNNLKLNGEPLKQEDKENIIKEIYEKKNKVKIKDIANYYKRNGFDVKPDDFTGFHEELKSSLRSYNLFFSLRGEKLDESAVEEAIRAVVLFGNDKKMLSQRLRNIKNGFFSETEINRISGFKFSDWGRLSKKLLTGIKETGETFNIIEALRVTNKNLMQLLSSEFDFKKKIDEENEKINGGIPEFSYDALVKDSYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRSAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGNNVAWVAGNNGTIATVKKTCSKENILFTRYAFEQKGGLFDQQIMKKGKGQLPTKPSDPHMQGQTEQEWIDKYGGYNKLSGAYFCLVEYKDKGKTVRSIESVPLLVSAKIKNDPSELEKYLKQALGTEELSVRIREIKFNILFNHNGFLMHITGRTGDQLVFKPALQLKVNASDYAYIKKIVRFCEREKESKKAFTVSGFDGIEKDRNIELFDFFTKKLSSDIFMVHHEPTLKSLLANRNIFVDMSVEMQARTIYQILHIFRCNRMLADLTALQGAKSAGIVRMSKRISSKDKTMIINQSPTGLFENSVDLLTV

SEQ ID NO: 8576 - protein, 1330 aa, unidentified
  REGION 1..1330: note = Description of Unknown:uncultivated organism sequence
MERCGKNAAYLGLDIGSTSVGWAVSDETYRLCRVKGKDMWGVRLFEEAQTAAARRVARVQRRRYDRRNQRLALLQELFQAQIARVDPAFFQRMDAARLWSQDKPWKYTLFEQKGWTDREYHAQYPTVYHLRRALMTQDGPFDVRLVYLALHHILKKRGHFLYADLGDGQLPELEEIIRELELRFEDELGMELRCHDIDTLRPLLMDSTLSISARQKQLNAVFAAETKQQKTWVKALTGAKVKLSELYEDPTLEEAEQKEAEFRKAGYEDGLPVLEAVLGDRFALLEAWRSLYNWGVLQRLLGGASSISEAKVRQYEQNKKDLAELKAVLRADRTLYNRVFRATDVPGNYASIVGHAWVEGKKQTVKVCGHEDFCKFIEKVLDTLEQDERVQALRTRAKEGTLLPKLISGDNSVIPYQLHRAEMEQILDRAAVYLPFLKEKDVEGLTPADKIRALLVFRIPYYVGPLNPHSPNSWFVRKTEGPIYPWNFEDRVDRVRSAQAFIDRMTSSCTYLRGCDVLPACSPIYERFTVLNELNPMTVKGEPLSIELKQALFEQVFLKIRKPGIRNIVGFLRAQGYDVSREDLGGIDVQGGVKSSLRTTLALQEILGEKYDDAKAEEIVLAATYFGDDRRLLREKLRSLGLTDDVIGRLLRLHCAGWGRLSRELLCEVTSFVPGQPDGASILDTLWKTNETLMGLLSDRYTFAEAIEARNREVGEESLYDFIDELYVSPSVKRQIRQTVLVARELRKVIGHDPKKIFIEMARGKEKKPERKPKRKQTLLACYETFQNEAGALYETLMQTDNQRLRQDKIYLYYTQMGRCMYSGERIDLEELLRSESLYDIDHIYPRSRVKDDSIDNRVLVKRTLNEKKGNDYPLSHEIVEGQRAFWSMLLYRKLISREKYERLTRRTGFTDEELTSFAARQLVETRQGTKAVAQLLGRMMPDSEIVYVKAGLVSDFRHARSLPKVRELNDLHHAKDAYLNIVVGNIYNTQFTHSPMRYICEHRDNYTVNLDSLLKMEIHRGGVLAWDPADGGSIATVRRTMARNSPLVTMMSVIYSGILFDLQPKPQGQGQMPLKKGLPIEKYGGYNKVTGACFMLVEHTLRRRRVRSLIDVPLHLYPDAVSHPELALRHCIEMRDLKEPRIILPIIRMRALLSLDGYKMYITGRTNGNLCIQNANQLMVSEEWEQYIKKIVKAARESMEYERLRGGDGYRPNPRDGLCPEKNLALYDLFVQKMERMPYCQRMSGQRDKLLQARAAFEALDVAQQCCILCQLLNLFSRVGGEADLTGIGLVKNFGILHPSGMISGCAQALLIHQSPTGLYERVVDLNRL

SEQ ID NO: 8577 - protein, 1360 aa, unidentified
  REGION 1..1360: note = Description of Unknown:uncultivated organism sequence
MNKDLNNIDYYIGLDCGTSSVGFAVTDTNYNILKFNGKRMWGSHLFEEAKTAAGRRGFRTARRRLERRRKRILLLQEIFAEEICKVDPTFFIRLNDSKYILEDKTTPDLNILFNDKNYKDKDFFKIYPTAYHLRKALMTEDIKDPRLLYLGIQHILKNRGHFLFPGEGMKAVESIKPLVDDIQNVFEELFDDVTFEYTSIEKLQEALMSKRNSEKKEKLEKEIIISDTKLKASVVRILLGYKVKTTTLFKKEGDEIPDVEFKKASFEESDLPELQDRLSDEEFAFIKAAKGIYDWTLLASIMSGHLYISDAKIELFDSNKADLKHLKEAIKTYAPDKYESFFHSDEKGSYSSYTGKIHGDHVVKRVKRTGTDEFYKKIKNLLEKVPKDDEHVKHILDAIENDSFMPLLKSFRNGTIPYQMNKIELDAILANCSKNFEFLEKKDPDGFSATEKIKELLKFRVPYYVGPLGSNPYGKETKGKNSWVERKTSGRVLPWNIEQKIDYESSAEKFIERMTNKCTYCKDQDVLPKNSLEYSKYMVLNELNNLRICGDRLSVPRKQEIFNELFKKEKKVSISKLTKYINDNCWYSGKIKKEDITGIDGDLKASLSSYFDFKDFLESHRLKADDVDRIIKWATVFSEGGDMLRKRIEREFGEVLTKEEIDKTSKLKYAGWGHFSHKFLYEIQAINKETGELMSVMRMLWETQNNLMELLSNKYEFIEQITKPKTIGKLDYSIVDEMYVSPAVKKETWQTLRIVDELIRIMGHNPQKVFVEVTRSEQEKKRTVSRKQTLIDTLKDATKTDSNYINELRELISKLEEKSESDVSRQDKLYLYFSQCGKCMYTGERIDIEDIYDISKYDIDHIFPRSRTKDDSLTNRVLVKKTTNNRKSNAYPIDDFIRAKMQSFWKFLYEKKFIPKEKYDRLVRNSPLSDEEINGFINRQLVETSQTVKQVTDTLKSLFGEETKVVYSKARNVSDFRNQYGFVKCRSMNDLHHAKDAYLNIVVGNVYDTKYSSNFYLQANGHGYGNLTKLFDFDVKNAWKVGASGTLSVVAKTMNRNDILFTRQLVTKKGKLFDIQLVKKGANKGTLPSKVSDKKLQSAIEDFENKESAYDDWTSKYGGYNSLATSHFAVIKHEEKNKKFVSFVPISMIDAKHLEKPGALMEYCSTTLGLINPTIVRSKLLINTQLKIDGYLFAITGKSTGGKALTLSSNVPLVLSAQSQQTVKNIESFFKKSEKNKDLQPTPKFDKISTENTLDLYCELQKKSKSPIYNKRPGNQSDVLENGVSLFEKLSLLERCKAIREILNYYAMEGNGQSDFTAIGGSKTCGKLTKKAGFDITKSNILIFDQSITGLFEEIEEIKA

SEQ ID NO: 8578 - protein, 1381 aa, unidentified
  REGION 1..1381: note = Description of Unknown:uncultivated organism sequence
MMKELKNYFVGLDMGTTSVGWAVTDENDEIIKKNGKALWGIRLFEEAETAADRRLHRISRRRIERRSRRIDLLQELFAQEICKKDPGFYERLNESGLYEEDKTIHQPNSLFNDVDFNDKAYHKAYPTIYHLRNALMTEDRVFDVRLVYLAIHHILKHRGHFLFDSFQVDENGASGFEECFGAFGNALDRIKGDSLDVSKEDAMKAACRDKKLGVKQKAAALVQCLGRGKDKAFKAMMTLAAGGTASLSDVFEDDGLKDFDKNKVNFSSIQFEENEPDIMAELGDRYDLIAALQGLYSWSLLAELMGDHKYISEAKIELYEKHGKDLKVLKRVLKQSPIDYAHMFKAQGSKKNTNYSAYVGVCKIKGKKVPVEKCGYEDFAKTVKSCLKNLPDSEDKKYIEKELEQGTFLPKAVSKENGVIPYQLHLQELKKILSRAEAYLPFLKEKDKYGTVSDKIISLFTFRIPYYVGPTNEHAKSCWVVKKDKTGKIYPWNFTEKIDVEKTAEGFIRNLTNKCTYLIGEDVLPKNSLLYTEFMVLNELNNVRIGQTMQKLSPELKEKILENLFRKHKHVARKRFINYLAAEGMDRKEAESISGLDGDFKSSLSSFIDMKGILGKDFKREDVERMITDITIFSGDKKMLRTRLHREFSYLSPKQLTSITRLSYEGWGRLSKELLVNLFPAEGDAYEVLADKTSGEVLNIISAMEQTSFNLMELLSSRFGYAKAIEERNREKEGNGTISYRDVEDMYISPAVKRPLWQALKIVREIVKILGKEPSKIFIEMARENGEKGRRTVSRKARLQELYKKCRDDSRDWAKELEERPEEDFRSDRLYLYYTQMGRSMYTGKPIDINQLFDRNVYDIDHIYPQSLTGDDSLDNRVLVEKTVNAKKGDTYPLGRALDGCHIGGQIHIQDIQKEMRPFWHMLYEKEFISKEKYNRLSRTIPLTDTEKAAFIGRQLVETRQSTKACAELLSKAYPDTRIVYTKAGNASRFRQYGGFIKVRDMNDYHHAKDAYLNIVVGNVFDTRFTSNPIRFLKGNHPVYSLNVEALYGHRVGRGGVDAWIPAEKDEEGHTCPGHEGTMGTVRKWMKKNNILFTRMPFEGKGGFFDQNIMKKGKGQVPLKENSPVSDIEKYGGYNKASSAYFVLTSSKLKNETIYTIETIPLIIKRMIQTNKDKEDYIKQHWKDHGKKMVNPHICYGHIPVQSLLEINGFKVHLTGKSGKDFKLRNAEQLCISNDDAAVLKRVLKYNERSSSSKGKEALLITPFDNIQEVDLNRLYQVFEDKLTNQVYKVKLGKQASVLKKGEGKFNELPLEVKCRVIGEILHLFQCNAAIADLRLIGGAKNAGALTMNPRVSSEDHVYLIEQSVTGFFEKRILLAPYGEK

SEQ ID NO: 8579 - protein, 1349 aa, unidentified
  REGION 1..1349: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVTDFETPFSALRDYLREEDYGFDFSDVDTDSLKECLKTKKGITQKKKELYVLLGNEKGTLKSVCDLLAGGSGIKLMDLFNDESLAGETPEKISLSDSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKMAIEKRTTASDFGKYIAKLLSSFDDSDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCSYLVGEDVLPKDSLLYSEYSVLNELNNLKLNGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAEFDFKKQIDAENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGSNVAWVAGNNGTIATVKKTCSKENILFTRYAFEQKGGLFDQQIMKKGKGQLPTKPSDPHMQGQTEQEWIDKYGGYNKLSGAYFCLVEYKDKGKIVRSIESVPLLVSAKIKNDPSDLEKYLKQALGTEELSVRIREIKFNTLFNHNGFLMHITGRTGDYLLFRPALQLKVNASDYAYIKKIVRFCEREKENKKEFSISGFDGIETDKNVKLFDSLAVKLSNKLYSVHYAKTAKSLLSNRESFVVLSAEMQTRTIYQMLHIFQCNRMCANLEPIHGVKNAGTVLMPKKVSFSDKTLIINQSPTGLFENSVDLLTV

SEQ ID NO: 8580 - protein, 1393 aa, unidentified
  REGION 1..1393: note = Description of Unknown:uncultivated organism sequence
MMKEIKNYFIGLDMGTTSVGWAATDENYEIIKKNGKALWGIRLFDEAQTAEDRRMHRIARRRIERRSRRIDLLQELFAQEICKKDPGFYERLNQSGLHEEDKKVHQPNSLFNDVDFNDKAYHKKYPTIYHLRHALMTENHPFDVRLVYLAIHHILKHRGHFLFENFQVDENGVSGFEESFAAFGNALEHIKGESLDMGKEEEMKALCKDKKLGVKHKALALAQCLGRSKDNDFKDMMSLAAGGQATLSKIFKDEGLKDFSKNKVSFSDSQFENDKPEIIAKLGDRYDLIAALHDLYNWSFLAELMRGHKYISEAKIEIYDKHKEDLALLKKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSIENGAIPYQLHLQELKIILSKAEAYLPFLKVRDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGEIMQKLPLRLKEKVMDNLFSCYKHVSRTKFIKYLVSEGIDKKEAESISGLDGDFKSSLSSLIDMKHILGNDFSREDAEKMIKDITIFGGDKKMLKNRLHCEFSYLTSEQLTSLTRLSYDGWGRLSREFLVNLLPVEGDSCEVLVDHTSGEVLNIISAMRQTSYNLMELLGSRFGYGQAIEERNRKEEGQGRITYKDVENLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTTSLSDAEKAAFIGRQLVETRQSTKACAELLSKAYPQTRIVYTKAGNASRFRQYGGFIKVRDMNDYHHAKDAYLNIVVGNVFDTRFTANPLNFLKGNHQAYSLNTEALYGHKVSRSGVDAWIPAEKDEKGQVMAGHEGTMGTVRKWMRKNNILFTRMPLEGKGGLFDQNIMKKGKGQVPLKGDSPVSDIGKYGGYNKAKAAYFVLTQSKLNENTVYTLETIPLILRNNIQSNKDKETYIQKQWKKNGTKMEHPLVCLGHIPVQSLLEINGFKAHLSGKNGKTFSLRNAEQLCINEADTAVLKKILKFNQRAVLSKKGEEISVNPFDNIQEEDLNRLYHVFEDKLTNQIYKVKLGKQAAVLKKGEETFNRLSPEQKCKLIGEILHLCQCNATNADLRLIGGAKNAGALTMSTQIYPKDHVYLIEQSVTGFFEKRILLAPFGEK

SEQ ID NO: 8581 - protein, 1360 aa, unidentified
  REGION 1..1360: note = Description of Unknown:uncultivated organism sequence
MKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPEENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSSFAWAVRKDENGHIYPWNFERKIDIEASAEEFIRRMTNKCTYLVKKDVLPKNSLLYTEFMVLNELNNVRIGSAQEKLPPGMKVRVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMHISPAVKRPLWQTLRVIKEIIHIMGKAPSRIFIEMARAEDEKKWKTVSRKDRLLDLYKKCKDEIRNWSADIKKLGEEIEELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRACGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8582 - protein, 1345 aa, unidentified
  REGION 1..1345: note = Description of Unknown:uncultivated organism sequence
MKNEKKSFGEYYLGIDAGTDSVGWAVMDGNYNVLKFHGKAMWGVRLFEEAQTAADRRAFRTARRRQGRKVQRTKLLQELFAEEICKKDSAFFIRMADSKYYAEDKTEPQQNALFNDVDYTDKDYHKEYPTVYHLRRAFIEGKDIRDPRLLYLAVHHIINNRGHFLFEGMDLSKVVDFETPFSVLKEYLREEDFGFDFSNIDADALKESLKTKQGITQKKKDLYKLLGKEKGTLKSVCDLLAGGSGIKLTDLFNDESLAGETPEKISLADSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCTYLVGEDVLPKDSLLYSKYSVLNELNNLKLNGEPLKQEDKENIIKEIYEKKNKVKIKDIANYYKRNGFDVKPDDFTGFHEELKSSLRSYNLFFSLRGEKLDESAVEEAIRAVVLFGNDKKMLSQRLRNIKNGFFSETEINRISGFKFSDWGRLSKKLLTGIKETGETFNIIEALRVTNKNLMQLLSSEFDFKKKIDEENEKINGGIPEFSYDALVKDSYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRSAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGNNVAWVAGNNGTIATVKKTCSKENILFTRYAFEQKGGLFDQQIMKKGKGQLPTKPSDPHMQGQTEQEWIDKYGGYNKLSGAYFCLVEYKDKGKTVRSIESVPLLVSAKIKNDPSELEKYLKQALGTEELSVRIREIKFNTLFNHNGFLMHITGRTGDQLVFKPALQLKVNASDYAYIKKIVRFCEREKESKKAFTVSGFDGIEKDRNIELFDFFTKKLSSDIFMVHHEPTLKSLLANRNIFVDMSVEMQARTIYQILHIFRCNRMLADLTALQGAKSAGIVRMSKRISSKDKTMIINQSPTGLFENSVDLLTV

SEQ ID NO: 8583 - protein, 1378 aa, unidentified
  REGION 1..1378: note = Description of Unknown:uncultivated organism sequence
MKEIKKIFIGLDMGTNSVGWTATDENYEVIKKNGKALWGIRLFDEAQTAEDRRMHRIARRRIERRSRRIDLLQELFAQEICKKDPGFYERLNESGLYEEDKRVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAVGGTASLSDIFNDEKLKDFEKNKVNFSSAQFEENEPDIMAELGDRYDLIAALHGLYNWSLLAELMGEYHYISEAKIAVYDKHKADLKVLKRVLKQSPKAYAEIFREPGSSANKNYSAYVGVCKVKGKKAAIEKCSYEDFTKTLKSCLKDMPDSNDKDYISRELNRGTFLPKSVSKENGVIPYQLHLQELKIILSKAEAYLPFLKVRDQYGTVSDKIISLFTFRIPYYVGPINEHANSCWVVKKDKQGKVYPWNFTEKIDVEKSAEGFIRNLTNKCTYLIGEDVLPKNSLLYSEFTVLNELNNVRIGETMQKLPLSLKEKVMDNLFSCYKHVSRTKFIKYLVSEGIDKKEAESVSGLDGDFKSSLSSLIDMKHILGNDFSREDAEKMIQDITIFGGDKKMLKNRLHREFSYLTPEQLTSLTRLSYDGWGRLSKEFLVHLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTEALYGHKVSRSGVDAWIPAEKDEKGQGIEGHEGTMGTVRKWMRKNNILFTRMPLEGKGGLFDQNIMKKGKGQVPLKGDSPISDIGKYGGYNKASIAYMMLVQAEEKGKPVYLLESIPNYVKNKLISDKERQAYCVRTWTAQGNKYRHPQILIPKIRIQSLFEIDGFKAHISGKTDDRFVMRNAQELCMDNALAGALKNILKFIHRKTVQKDAVITEYDGVSDDNTLALYDFFVDKLSSSIYGKKFATQADFLRQSKDKFTNLSLEERCEVLGSILHLFQCNAVLSDFHLLGGSRQAGRIYLKKNIKAQDHVYLIEQSVTGFFEKRILLAPFGEK

SEQ ID NO: 8584 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKILRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMSISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLKAQGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQAQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8585 - protein, 1349 aa, unidentified
  REGION 1..1349: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYSEDKTEPQQNALFNDVDYTDKDYHKEYPTVYHLRRAFIEGKDIRDPRLLYLAVHHIINNRGHFLFEGMDLSKVVDFETPFSILKEYLREEDFGFDFSNIDADALKESLKTKQGITQKKKDLYKLLGKEKGTLKSVCDLLAGGSGIKLTDLFNDESLAGETPDKISLSDSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCSYLVGEDVLPKDSLLYSEYSVLNELNNLKLSGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAELDFKKQIDAENEKINGGIPEFSYDALVKDCYASPAVKRSIWQVLTIAKEIEKITGHAPKKIFMETTREDREKKATKSRKKQLVELYKKCREETSGLLKTLEKREDSELRNNALYLYYTQMGKCMYSGETIELEHLFDKNVYDIDHIYPQSKTKDDSLNNKVLVKKELNGQKSDRYPVPRDVLSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGNNVAWVAGNNGTIATVKKTCSKENILFTRYAFEQKGGLFNQQIMKKGKGQLPTKPSDPHMQGQTEQEWIDKYGGYNKLSGAYFCLVEYKDKGKIVRSIESVPLLVSAKIKNDPSDLEKYLKQALGTEELSVRIREIKFNTLFNHNGFLMHITGRTGDQLVFKPALQMKVNATDYAYIKKIVRFCEREKESKKEFTVSGFDGIEKDRNIELFDFFTKKLSSDIFMVHHAATLKSLSESRNIFVDMSVEMQARTICQILHIFRCNRMLADLTALQGAKNAGTVLMSKKISPNDKTMIINQSPTGLFENSVDLLTV

SEQ ID NO: 8586 - protein, 1351 aa, unidentified
  REGION 1..1351: note = Description of Unknown:uncultivated organism sequence
MKKHQDYFLGLDLGTGSVGWCVTDTEYRILKANRKRTIGTVLFSTAETAKERRTLRCARRRLRRQKERLRCLQELFREEIEKVDPGFFFRLQESPYVVEEKQNPDGSRAELPYALFVDKDYTDKEFHAQYPTIYHLRKELMDNPLPHDARLVYLAAEHIIKHRGHFLSSISAEGKEASFEDLLSQFLQLWNEYMDHTLTLLEEEKGKLKEPLLDAGMTKSGKKTAIIRLLGTKEPQLKEMAALLTGASASIEKLFDKEEYKNLEENKIQFDAPSYEEKEEYYREALGDDFEIIARARAIYNWCALSRILKNNPGGRISDARVEDYERHRTDLQLLKKLLRENFPKETQERILKVSEKGLANYPAYIGMTKKNGKKAPVVERCSKEDFYKLLDKEILKNLGDSEEKAYIEQQIRLGGFLPKQKGNGNSVVPYQLHEKELKLILKNAEGYLPFLKEKDESGYTVSEKILQLLTFRIPYYVGPLYGGGGEHSYAWVKRLEDGKVYPWNFEQKIDVEKSAEEFIRRAVSTCSWLKNEKVLPAGSLLFEKFKVLNELNNVRIYGERLEVDIKQRIYQELFCRHLRITKKRLIQYLKKEGIYAKVEPEDISGLDENFQSSLKSLLAFKQIHFDSPVPEQAMEDMIKDITLFGEDPKLLKKRLLVKYPEYGKQIPAIIKTVKCDGWASLSEKLLTGLAVDIPGEGRVGTILYFLWNTRQNLMEILYNPEYSFQDLIKTENGDTGRKDGKISYELVDELYVSPSVKRQIWMALKVIEEVRHFMGCEPKRIFVEMAREKQESKRTSDRKAQIMQLYAAIRTDKDYKELLKELSGCSNDELRKDKLFLYFMQMGRCAYTGKRIPFSDLKYDSLYDIDHIYPRSQTADDSLDNRVLVTAQYNREKKQDLYPIEKETRDEREALWRFWREKKFISDEKYRRLTRATKLTNEELLGFVNRQLVETRQSTKALAEVLNQTKAEQTEIVYVKAKNVTEFRRRYKLLKVRALNDFHHAQDAYLNIVVGNVYHLKFTKDVRRYFLDKGTYRTYNLTKMFDETVKCGEETAWIKGVSIGTVKEMMKNEKILVSRQIYEEKGKLYDVQRLKKGQGQVPVKESGRMSDISRYGGYGSAKNTYFMLVEAEDKKKKESLWILPVPLYLKQKIEGSEEYARSYFEQEYGLCHVRVLKKIRIQSLFVYEGFRMRLAGRSGSQLVFHNANELCLPARHHNTIRQISKHIQELQYDKDAAVSDNGLLTEQDLDALYTELCEKLKGSVYQTMLGGYIEKYESGYEKYQKLTLEKKAQALWQMLKIFQCTPEMPDLTLIGGSKSQGAIRMGMNVTGRKSLALIHQSVTGIYERVEKIRG

SEQ ID NO: 8587 - protein, 1360 aa, unidentified
  REGION 1..1360: note = Description of Unknown:uncultivated organism sequence
MKEINEYYLGLDMGEGSLGWTVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPEENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSSFAWAVRKDENGHIYPWNFERKIDIEASAEEFIRRMTNKCTYLVKKDVLPKNSLLYTEFMVLNELNNVRIGSAQEKLPPGMKVRVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMHISPAVKRPLWQTLRVIKEIIHIMGKAPSRIFIEMARAEDEKKWKTVSRKDRLLDLYKKCKDEIRNWSADIKKLGEEIEELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRACGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8588 - protein, 1341 aa, unidentified
  REGION 1..1341: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYAEDKTEPQQNALFDDVDYTDKDYHKEYPTVYHLRRAFIEGKDIRDPRLLYLAVHHIINNRGHFLFEGMDLSKVVDFETPFSILKEYLREEDFGFDFSNIDADALKESLKNKQGITQKKKDLYKLLGKEKGTLKSVCDLLAGLFNDESLAGETPDKISLSDSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCSYLVGEDVLPKDSLLYSEYSVLNELNNLKLSGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAELDFKKQIDAENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDILSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGSNVAWVAGNNGTIATVKKTCSKENILFTRYAFEQKGGLFDQQIMKKGKGQLPTKPSDPHMQGQTEQEWIDKYGGYNKLSGAYFCLVEYKDKGKIVRSIESVPLLVSAKIKNDPSDLEKYLKQALGTEELSVRIREIKFNTLFNHNGFLMHITGRQGNQLIFKPALQLKVNASDYAYIKKIVRFCEREKESKKAFTVSGFDGIEKDRNIELFDFFTKKLSSDIFMVHHAATLKSLLANRSIFVDMSVEMQARTIYQILHIFRCNRMLADLTALQGAKSAGTVLMSKKISLNDKIMIINQSPTGLFENSVDLLTV

SEQ ID NO: 8589 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNEHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRHWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8590 - protein, 1392 aa, unidentified
  REGION 1..1392: note = Description of Unknown:uncultivated organism sequence
MKEIKNYFIGLDMGTTSVGWAATDENYEIIKKNGKALWGIRLFDEAQTAEDRRMHRIARRRIERRSRRIDLLQELFAQEICKKDPGFYERLNQSGLHEEDKKVHQPNSLFNDVDFNDKAYHKKYPTIYHLRHALMTENHPFDVRLVYLAIHHILKHRGHFLFENFQVDENGVSGFEESFAAFGNALEHIKGESLDMGKEEEMKALCKDKKLGVKHKALALAQCLGRSKDKDFKAMMSLAVGGQATLSEIFKDEGLKDFSKNKVNFSNSQFEDNKPEIIAKLGDRYDLIAALHDLYNWSFLAELMKGHKYISEAKIEIYDKHKEDLALLRKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSVENGAIPYQLHLQELKIILSKAEAYLPFLKVRDQYGTVSDKIISLFTFRIPYYVGPINEHANSCWVVKKDKQGKVYPWNFTEKIDIEKSAEDFIRNLTNKCTYLIGEDVLPKNSLLYSEFTVLNELNNVRIGETMQKLPLRLKEKVMDNLFSRHKHVSRTKFIKYLVSEGIDKKEAESISGLDGDFKSSLSSLIDMEHILGNDFSREDAEKMIKDITIFGGDKKMLKNRLHREFSYLTSEQLTSLTRLSYDGWGRLSREFLVNLLPAEGDSCEILVDHTSGEVLNIISAMRQTSYNFMELLGSRFGYGQAIEERNRKEEGQGRITYKDVEDLYISPAVRRPLWQALKIVREIVKITGKEPSKIFIEMARGNGEKGKRTISRKARLQALYKKCKDDTRDWTKELKGKPEEDFRSDRLYLYYTQMGRSMYTGKPIDINRLFDRNVYDIDHIYPQSLTGDDSLDNRVLVEKTVNAKKGNTYPLSSALDGCYISGQQIRIQDIQKEMRPFWHMLLEKELISKEKYNRLSRTIPLSDAEKAAFIGRQLVETRQSTKACAELLSKAYPQTRIVYTKAGNASRFRQYGGFIKVRDMNDYHHAKDAYLNIVVGNVFDTRFTTNPLHFLKGNHPVYSLNTEALYGHKVSRSGVDAWIPAEKDEKGQVIDGHEGTMKTVQKWMRKNNILFTRMPYEGKGGLFDQNIMKKGKGQVPIKGDSLISNIKKYGGYNKAKVAYFVLTQSKLNKKTVYTLEAIPLILKNSIQSNKDKETYIQKQWRKNGKKMEHPIVCLGHIPVQSLLEINGFKVHLSGKNGKDILLRNAEQLCINEADTAVLKKILKFNQRAAMSKKGEEISINSFDNIQEEDLNRLYHVFEDKLTNQIYKVKLGKQAAVLKKGEETFNLLTPEQKCKLIGEILHLCQCNATHADLHLIGGAKEAGALTMSTQINPKDHVYLIEQSVTGFFEKRILLAPFGEK

SEQ ID NO: 8591 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKILRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8592 - protein, 876 aa, unidentified
  REGION 1..876: note = Description of Unknown:uncultivated organism sequence
MKEIKKIFIGLDMGTTSVGWAATDENYEVIKKNGKALWGIRLFDEAQTAEDRRMHRIARRRIERRSRRIDLLQELFAQEICKKDPGFYERLNESGLYEEDKTVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAVGGTASLSDIFNDEKLKDFEKNKVNFSSARFEENEPDIMAELGDRYDLIAALHGLYNWSLLAELMGEHHYISEAKIAVYDKHKADLKVLKRVLKQSPKAYAEIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVKDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGETMQKLPLRLKEKVMDNLFSCHKHVSRTKFIKYLVSEGIDKKEAESISGLDGNFKNSLSSLIDMKHILGNDFSREDAEKIIQDITIFGGDKKMLKKRLHREFSYLTPEQLTSLTRLSYDGWGRLSRELLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSSREK

SEQ ID NO: 8593 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKILRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMSISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQAQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8594 - protein, 1345 aa, unidentified
  REGION 1..1345: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYAEDKTEPQQNALFDDVDYTDKDYHKEYPTVYHLRRAFIEGKDIRDPRLLYLAVHHIINNRGHFLFEGMDLSKVVDFETPFSILKEYLREEDFGFDFSNIDADALKESLKNKQGITQKKKDLYKLLGKEKGTLKSVCDLLAGGSGIKLTDLFNDESLAGETPDKISLSDSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCSYLVGEDVLPKDSLLYSEYSVLNELNNLKLSGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAELDFKKQIDAENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDILSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGSNVAWVAGNNGTIATVKKTCSKENILFTRYAFEQKGGLFDQQIMKKGKGQLPTKPSDPHMQGQTEQEWIGYNKLSGAYFCLVEYKDKGKIVRSIESVPLLVSAKIKNDPSDLEKYLKQALGTEELSVRIREIKFNTLFNHNGFLMHITGRQGNQLIFKPALQLKVNASDYAYIKKIVRFCEREKESKKAFTVSGFDGIEKDRNIELFDFFTKKLSSDIFMVHHAATLKSLLANRSIFVDMSVEMQARTIYQILHIFRCNRMLADLTALQGAKSAGTVLMSKKISLNDKIMIINQSPTGLFENSVDLLTV

SEQ ID NO: 8595 - protein, 1379 aa, unidentified
  REGION 1..1379: note = Description of Unknown:uncultivated organism sequence
MMKEIKKIFIGLDMGTNSVGWAATDENYEVIKKNGKALWGIRLFDEAQTAEDRRMHRIARRRIERRSRRIDLLQELFAQEICKKDPGFYERLNESGLYEEDKRVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAAGGTASLSDIFNDEKLKDFEKNKVNFSSAQFEENEPDIMAELGDRYDLIAALHGLYNWSLLAELMGEHHYISEAKIAVYDKHKADLKVLKRVLKQRPDIYAKIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVRDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGENMQKLPLSLKEKAMDNLFSCYKHVSRAKFIKYLVSEGIDKKEAESISGLDGDFKSSLSSLIDMKHILGNDFSREDAEKMIKDITIFGGDKKMLKNRLHREFSYLTSEQLTSLTRLSYDGWGRLSREFLVHLLPAEGNSYEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVERTVNAKKGDTYPLSSALDGCYISGQQIRIQDIQKEMRPFWHMLLEKELISKEKYNRLTRTIPLSDTEKAAFIGRQLVETRQSTKACAELLSKAYPQTRIVYTKAGNASRFRQYGGFIKVRDMNDYHHAKDAYLNIVVGNVFDTRFTANPFHFLKGNHPVYSLNTEALYGHKVSRNGVDAWIPAEKDEKGQVIDGHEGTMGTVRKWMRKNNILFTRMPLEGKGGLFDQNIMKKGKGQVPLKGDSPISDIGKYGGYNKASIAYMMLVQAEEKGKPVYLLESIPNYVKNKLISDKERQAYCVRTWTAQGNKYRHPQILIPKIRIQSLFEIDGFKAHISGKTDDRFVMRNAQELCMDNALAGALKNVLKFIHRKTVQKDAVITEYDGVSDDNTLALYDFFVDKLSSSIYGKKFATQADFLRQSKDKFMNLPLEERCEVLGSILHLFQCNAVLSDFHLLGGSRQAGRIYLNKKIKAQDHVYLIEQSVTGFFEKRILLAPFGEK

SEQ ID NO: 8596 - protein, 1383 aa, unidentified
  REGION 1..1383: note = Description of Unknown:uncultivated organism sequence
MKEIKKIFIGLDMGTNSVGWAATDENYEVIKKNGKALWGIRLFDEAQTAEDRRMHRIARRRIERRSRRIDLLQELFAQEICKKDPGFYERLNESGLYEEDKTVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFNAMMTLAAGGTASLSDIFNDEKLKDFEKNKVNFSGAQFEENEPDIMAELGDRYDLIAALHGLYNWSLLAELMGEHRYISEAKIAVYDKHKADLKVLKRVLKQSPDIYAKIFREPGSNANKNYSAYVGVCKVKGKKAAIEKCSYEDFAKTLKSCLKEMPDNNDKDYISRELDMGTFLPKSVSKENGVIPYQLHLQELKIILSKAEAYLPFLKVRDQYGTVSDKIISLFTFRIPYYVGPINEHANSCWVVKKDKQGKVYPWNFTEKIDIEKSAEGFIRNLTNKCTYLIGEDVLPKNSLLYSEFTVLNELNNVRIGETMQKLPLSLKEKVMDNLFSCYKHVSRTKFIKYLVSEGIDKKEAESISGLDGDFKSSLSSLIDMKHILGNDFSREDAEKMIKDITIFGGDKKMLKNRLHREFSYLTPEQLTSLTQLSYDGWGRLSKEFLVNLLPAEGNSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGKRTISRKARLQALYKKCKDDTRDWTKELKGKPEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTIPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPAYSLNTEALYGHKVSRNGVDAWIPAEKDERGQVIEGHEGTMKTVQKWMKKNNILFTRMPYEGKGGLFDQNIVKKKKGQKKKGLVPIKGKPPISDIEKYGGYNKASIAYIMLVQAEEKGKPVYLLESIPNYVKNKLTSDKERQAYCVKTWTVQENKCRNPQILIPKIRIQSLFEIDGFKAHISRKTNDQFAMRNAQELCMDNALAGVLKKVLKFIQRETVQKNAAITEYDGISNDNTSELYDFFVDKLSNSIYGKKFAAQADFLRQSKDKFMNLLLEERCEVLGSILHLFQCNPVLSDLRLLGGKKSTGTILLNKKIKPEDHVYLIEQSVTGFFEKRILLAPFGEK

SEQ ID NO: 8597 - protein, 1393 aa, unidentified
  REGION 1..1393: note = Description of Unknown:uncultivated organism sequence
MMKEIKNYFIGLDMGTTSVGWAATDENYEIIKKNGKALWGIRLFDEAQTAEDRRMHRIARRRIERRSRRIDLLQELFAQEICKKDPGFYERLNQSGLHEEDKKVHQPNSLFNDVDFNDKAYHKKYPTIYHLRHALMTENHPFDVRLVYLAIHHILKHRGHFLFENFQVDENGVSGFEESFAAFGNALEHIKGESLDMGKEEEMKALCKDKKLGMKHKALALAQCLGRSKDKDFKAMMSLAVGGQATLSEIFKDEGLKDFSKNKVNFSNSQFEDNKPEIIAKLGDRYDLIAALHDLYNWSFLAELMKGHKYISEAKIEIYDKHKEDLALLKKVLKQDRSAYNRMFKEPKDEEPKGKKTKEKTTNYSDYVKACKTNGKKLPFPYKKFNHEEFIKTVKSCLKNIPDSPDKKNIENKLEEGTFLPKAVSVENGAIPYQLHLQELKIILSKAEAYLPFLKVRDQYGTVSDKIISLFTFRIPYYVGPINEHANSCWVVKKDKQGKVYPWNFTEKIDIEKSAEDFIRNLTNKCTYLIGEDVLPKNSLLYSEFTVLNELNNVRIGETMQKLPLRLKEKVMDNLFSRHKHVSRTKFIKYLVSEGIDKKEAESISGLDGDFKSSLSSLIDMEHILGNDFSREDAEKMIKDITIFGGDKKMLKNRLHREFSYLTSEQLTSLTRLSYDGWGRLSREFLVNLLPAEGDSCEILVDHTSGEVLNIISAMRQTSYNFMELLGSRFGYGQAIEERNRKEEGQGRITYKDVEDLYISPAVRRPLWQALKIVREIVKITGKEPSKIFIEMARGNGEKGKRTISRKARLQALYKKCRDDTRDWTKELKGKPEEDFRSDRLYLYYTQMGRSMYTGKPIDINRLFDRNVYDIDHIYPQSLTGDDSLDNRVLVEKTVNAKKGNTYPLSSALDGCYISGQQIRIQDIQKEMRPFWHMLLEKELISKEKYNRLSRTIPLSDAEKTAFIGRQLVETRQSTKACAELLSKAYPQTRIVYTKAGNASRFRQYGGFIKVRDMNDYHHAKDAYLNIVVGNVFDTRFTTNPLHFLKGNHPVYSLNTEALYGHKVSRSGVDAWIPAEKDEKGQVIDGHEGTMKTVQKWMRKNNILFTRMPYEGKGGLFDQNIMKKGKGQVPIKGDSLISNIKKYGGYNKAKVAYFVLTQSKLNKKTVYTLEAIPLILKNSIQSNKDKETYIQKQWRKNGKKMEHPIVCLGHIPVQSLLEINGFKVHLSGKNGKDILLRNAEQLCINEADTAVLKKILKFNQRAAMSKKGEEISINSFDNIQEEDLNRLYHVFEDKLTNQIYKVKLGKQAAVLKKGEETFNLLTPEQKCKLIGEILHLCQCNATHADLHLIGGAKEAGALTMSTQINPKDHVYLIEQSVTGFFEKRILLAPFGEK

SEQ ID NO: 8598 - protein, 1360 aa, unidentified
  REGION 1..1360: note = Description of Unknown:uncultivated organism sequence
MKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGVKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8599 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDGNGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGCSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8600 - protein, 990 aa, unidentified
  REGION 1..990: note = Description of Unknown:uncultivated organism sequence
MYTRGFCRGNKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDGNGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKRKTVSRKDRLLDLYKKCNDEIRHWSADIKKLGEEIKELSDGQLRSDKLYLYYTQMGRSMYTGKPICLGSLMAGADYDIDHIYPRSATGDDSLDNRVLVEKTENAKKGDHYPLSVEIQRERADFWKILLDKGLISKEKYHRLTRKTLLTDDEKAGFIGRQLVETRQSTKAVAEILKKAFPETKIIYTKARNVSRFRQYAGFVKVRDMNDYHHAKDAYLNIVVGNAFYTKFTSNPVHFLSEKNAVYSLNEKSFYQFPIQRGSTMAWEPGDNGTMAVVRKWMDKNNILYTRMPFEEKGGLFDQNIRKKGKGQVSLKAQGALSDIQKYGGYNKATASYFMLVKAEKNGKRIYLLETVPLHLSERLESIDDKTDFCRELWHKEGKGYKNPVICIPKIYKQSLFEVDGFREHISAKTGDRFVMRNAEQLCLNAESAQIIKNVLKFNQRKQVQKELKVTVHDKITEENLINIFEAFISKIQTSIYRNKFKKFVSLMIKEKGTFIELSMEDKCKCIGEILHLFQCNPVLSNLQLIGGEKASGKISMGKKFDGNEKVFLILQSVTGFFEKKILLAPYEKK

SEQ ID NO: 8601 - protein, 1378 aa, unidentified
  REGION 1..1378: note = Description of Unknown:uncultivated organism sequence
MMKELKNYFVGLDMGTTSVGWAVTDENYEIIKKNGKALWGIRLFEEAQTAAERRMHRISRRRIERRSRRIDLLQELFAQEICKKDPGFYERLNESGLYEEDKTVHQKNSLFNDVDFDDKAYYKEYPTIYHLRYDLMTKDRPFDVRLVYLAVHHILKHRGHFLFDSFQIDENGASGFDESFAAFGNALYRIRGISLDVRGTDTVKDIFRNKKLGVKEKAKALLQALGKEKEKDFKAMMTLAAGGTALLSDILGEEGMKDFEKNKVSFSSAQFEENEPDIMAELGDRYDLIAALHGLYNWSLLAELIGNYRYISEAKKAIYNKHKEDLKVLKRVLKQNPAVYAKIFKEPGSKSNKNYSAYVGVCKVKGKKAAIDKCSYEDFAKTLKSCLKDLPDSKDTEYISRELEQGTFLPKSVTKENGVIPYQLHLQELKKILANAEKYLPFLKIKDAYGTVSDKIISLFTFRIPYYVGPVNEHANSCWAVKKDKKGKVYPWNFSEKIDVEKSAEGFIRNLTNKCTYLIGEDVLPKNSLLYSEFTVLNELNNVRIGENAQKLSPELKEKVLENLFKKHKHVSRRKFINYLVTEGIDKKEAESISGLDGDFKSSLSSLIDLTNILGNDFSREDGEQMIKDITIFGGDRKMLKSRLHREFPYLTPEQLTRLIHLSYQGWGRLSKELLVNLLPAEKSTGEVLVDKGSGEVLNIISAMEQTSYNLMELLSSRFGYATAIEERNREKEGNGTISYQDVEDMYISPAVKRPLWQALKIVREIVKILGKEPSKIFIEMARENGEKGKRTISRKARLQELYKKCRDDSRDWAKELAEKPEEDFRSDRLYLYYTQMGHSMYTGKPIDINQLFDRNVYDIDHIYPQSLTGDDSLDNRVLVEKTVNAKKGDTYPLGSALDGCHIGGQIHIQDIQKEMRPFWRMLLEKGLISKEKYNRLSRTTPLSDTEKAAFIGRQLVETRQSTKACAELLSKAYPQAGIVYTKAGNASRFRQYGGFIKVRDMNDYHHAKDAYLNIVVGNVFDTRFTSNPIRFLKGNHPVYSLNVEALYGHRVSRGGVDAWIPPEKDDEGHIMAGHEGTMGTVRKWMRKNNILFTRMPLEGKGGLFDQTIMKKGKGQVPLKGDSPVSDIEKYGGYNKASVAYMMLVKAEEKGEPAYILESVPNYVKNQLKTDKERQEYCAGIWVAQGSRYTNPEICIPEIRIQSLFEMNGFKAHISGKTGNLYVMRNAQELCMDDLLAKILKNVLKFNNRKAVQKDAVVTAYDGITDENTLELYDFFADKLSHSIYRKKLSAQADFLDQSKDKFAGLPLEERCEVLGAILHLFQCNAVLSDFHLLGGSRQAGRIYLNKKIKAQDHVYLIEQSVTGFFEKRILLAPYGEK

SEQ ID NO: 8602 - protein, 1360 aa, unidentified
  REGION 1..1360: note = Description of Unknown:uncultivated organism sequence
MKEINEYYLGLDMGEGSLGWAVTTPDYHVVKKAGKALWGVRLFELAKTAKERRVFRTGRRRIERRNQRIDFLQELFSEAVCEKDPGFYQRLNDSRLWEEDKTERQINSLFNDVDFTDKSYHKKFPTIYHLRQKLMDDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDGNGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8603 - protein, 1381 aa, unidentified
  REGION 1..1381: note = Description of Unknown:uncultivated organism sequence
MKEIKKIFIGLDMGTTSVGWAATDENYEVIKKNGKALWGIRLFDEAQTAEDRRMHRIARRRIERRSRRIDLLQELFAQEICKKDPGFYERLNESGLHEEDKSIRQANSLFNDDDYDDKAYHKKYPTIYHLRHALMTENHPFDVRLVYLAIHHILKHRGHFLFENFQTDEKGTSGFDESFAAFGSALDRIRGSSPDVRKADSMKDILKDKKLGVKEKAASLLQCLGQGKEKDFKAMMTLAAGGTASLSDIFNDEKLKDFEKNKVNFSSPQFEENEPDIMAELGDRYDLIAALHGLYNWSLLAELMGEYHYISEAKIAVYDKHKADLKVLKRVLKQSPKAYAKIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVRDQYGTVSDKIISLFTFRIPYYVGPINEHANSCWVVKKDKQGKVYPWNFTEKIDIEKSAEGFIRNLTNKCTYLIGEDVLPKNSLLYSEFTVLNELNNVRIGETMQKLPLRLKEKVMDNLFSCYKHVSRTKFIKYLVSEGIDKKEAESISGLDGDFKSSLSSLIDMKHILGNDFSREDAEKMIQDITIFGGDKKMLKNRLHREFSYLTPEQLTSLTRLSYDGWGRLSREFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLTRTIPLSDAEKAAFIGRQLVETRQSTKACAELLSKAYPQTRIVYTKAGNASRFRQYGGFIKVRDMNDYHHAKDAYLNIVVGNVFNTRFTANPLNFLKENHQVYSLNTEALYGHKVSRNGVDAWIPAEKDEKGQVMAGHEGTMGTVRKWMRKNNILFTRMPYEGKGGLFDQNIMKKEKGQVPIKGDSPISNIKKYGGYNKAKVAYFVLTQSKLNKKTVYTLEAIPLILKNSIQSNKDKETYIQKQWRKNGKKMEHPIVCLGHIPVQSLLEINGFKVHLSGKNGKDILLRNAEQLCINEADTAVLKKILKFNQRAAMSKKGEEIFINSFDNIQEEDLNRLYHVFEDKLTNQIYKVKLGKQAAVLKKGEETFNRLSPEQKCKLIGEILHLCQCKATHADLRLIGGAKKAGILTMGTQIYPKDHVYLIEQSVTGFFEKRILLAPFGEK

SEQ ID NO: 8604 - protein, 1381 aa, unidentified
  REGION 1..1381: note = Description of Unknown:uncultivated organism sequence
MKEIKKIFIGLDMGTNSVGWTATDENYEVIKKNGKALWGIRLFDEAQTAEDRRMHRIARRRIERRSRRIDLLQELFAQEICKKDPGFYERLNESGLYEEDKTVHQTNSLFNDVDFNDKAYHKKYPTIYHLCHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAAGGTASLSDIFNDEKLKDFEKNKVNFSSAQFEENEPDIMAELGDRYDLIAALHGLYNWSLLAELMGEHHYISEAKIAVYDKHKADLKVLKRVLKQSPDIYAKIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVKDQYGTVSDKIISLFTFRIPYYVGPVNEHAGSCWVVKKDKQGKVYPWNFTEKIDIEKSAEGFIRNLTNKCTYLIGEDVLPKNSLLYSEFTVLNELNNVRIGETMQKLPLRLKEKVMDNLFSCHKHVSRTKFIKYLVSEGIDKKEAESISGLDGDFKSSLSSLIDMKHILGNDFSREDAEKMIKDITIFGGDKKMLKNRLHREFSYLTPEQLTSLTRLSYDGWGRLSREFLVNLLPAEGDSCEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTTTLSDAEKAAFIGRQLVETRQSTKACAELLSKAYPQTRIVYTKAGNASRFRQYGGFIKVRDMNDYHHAKDAYLNIVVGNVFDTRFTANPFHFLKGNHPVYSLNTEALYGHKVSRNGVDAWIPAEKDEKGQVIDGHEGTMGTVRKWMRKNNILFTRMPLEGKGGLFDQNIMKKGKGQVPLKGDSPVSDIGKYGGYNKAKAAYFVLTQSKLNENTVYTLETIPLILRNNIQSNKDKETYIQKQWKKNGTKMEHPLVCLGHIPVQSLLEINGFKAHLSGKNGKTFSLRNAEQLCINEADTAVLKKILKFNQRAVLSKKGEEISINPFDNIQEEDLNRLYHVFEDKLTNQIYKVKLGKQAAVLKKGEETFNRLSPEQKCKLIGEILHLCQCNATNADLRLIGGAKNAGALTMSTQIYPKDHVYLIEQSVTGFFEKRILLAPFGEK

SEQ ID NO: 8605 - protein, 576 aa, unidentified
  REGION 1..576: note = Description of Unknown:uncultivated organism sequence
MKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKCVLI

SEQ ID NO: 8606 - protein, 788 aa, unidentified
  REGION 1..788: note = Description of Unknown:uncultivated organism sequence
MCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8607 - protein, 1379 aa, unidentified
  REGION 1..1379: note = Description of Unknown:uncultivated organism sequence
MMKEIKKIFIGLDMGTTSVGWAVTDENYEVIKKNGKALWGIRLFDEAQTAEDRRMHRIARRRIERRSRRIDLLQELFAQEICKKDPGFYERLNESGLYEEDKRVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKSASLLQCLGQGKEKDFKAMMTLAAGGTASLSDIFNDEKLKDFEKNKVNFSSAQFEENEPDIMAELGDRYDLIAALHGLYNWSLLAELMGEYHYISEAKIAVYDKHKADLKVLKRVLKQRPDIYAKIFREPGSSANKNYSAYVGVCKVKGKKAAIEKCSYEDFTKTLKSCLKEMPDNNDKDYISRELNMGTFLPKSVSKENGVIPYQLHLQELKIILSKAEAYLPFLKVRDQYGTVSDKIISLFTFRIPYYVGPINEHANSCWVVKKDKQGKVYPWNFTEKIDIEKSAEGFIRNLTNKCTYLIGEDVLPKNSLLYSEFTVLNELNNVRIGETMQKLPLRLKEKVMDNLFSRHKHVSRTKFIKYLVSEGIDKKEAESISGLDGDFKSSLSSLIDMKHILGNDFSREDAEKMIQDITIFGGDKKMLKNRLHREFSYLTPEQLTSLTQLSYDGWGRLSREFLVNLLPAEGDSYEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTTPLSDAEKAAFIGRQLVETRQSTKACAELLSKAYPQTRIVYTKAGNASRFRQYGGFIKVRDMNDYHHAKDAYLNIVVGNVFDTRFTANPLHFLKGNHPVYSLNTEALYGHKVSRNGVDAWIPAEKDEKGQVIDGHEGTMKTVQKWMRKNNILFTRMPLEGKGGLFDQNIMKKGNGQVPLKGDSPISDIEKYGGYNKASIAYMMLVQAEEKGKPVYLLESIPNYVKNKLTSDKERQEYCVRTWTAQGNKYRHPQILIPKVRIQSLFEIDGFKAHISGKTDDRFVMRNAQELCMDNALAGVLKNILKFIHRKTVQKDAVITEYDGVSDDNTLALYDFFVDKLSSSIYGKKFATQSDFLRQSKDKFMNLPLEERCEVLGSILHLFQCNAVLSDFHLLGGSRQAGRIYLNKKIKAQDHVYLIEQSVTGFFEKRILLAPFGEK

SEQ ID NO: 8608 - protein, 1381 aa, unidentified
  REGION 1..1381: note = Description of Unknown:uncultivated organism sequence
MMKEIKNYFIGLDMGTTSVGWAATDENYEIIKKNGKALWGIRIFDEAQTAADRRMHRIARRRIERRSRRIDLLQELFAQEICKKDPGFYERLNESGLYEEDKTVHQKNSLFNDVDFDDKAYYKEYPTIYHLRYDLMTKDRPFDVRLVYLAVHHILKHRGHFLFDSFQIDENGASGFDESFAAFGNALYRIRGISLDVRGTDTVKDIFRNKKLGVKEKAKALLQALGKEKEKDFKAMMTLAAGGTALLSDILGEEGMKDFEKNKVSFSSAQFEENEPDIMAELGDRYDLIAALHGLYNWSLLAELMGNYRYISEAKKAIYNKHKEDLKVLKRVLKQNPAVYAKIFKEPGSKSNKNYSAYVGVCKVKGKKSSIDKCSYEDFAKTLKSCLKDLPDSKDMEYISRELEQGTFLPKSVTKENGVIPYQLHLQELKKILAIAEKYLPFLKIKDAYGTVSDKIISLFTFRIPYYVGPVNEHANSCWAVKKDKKGKVYPWNFSEKIDVEKSAEGFIRNLTNKCTYLIGEDVLPKNSLLYSEFTVLNELNNVRIGENAQKLSPELKEKVLENLFKKHKHVSRRKFINYLVTEGIDKKEAESISGLDGDFKSSLSSLIDLTNILGNDFSREDGEQMIKDITIFGGDRKMLKSRLHREFPYLTLEQLTRLIHLSYQGWGRLSKELLVNLLPAEKSAGEVLVDKGSGEVLNIISAMAQTSYNLMELLSSRFGYAKAIEERNREKEGNGTISYQDVEDMYISPAVKRPLWQALKIVREIVKILGKEPSKIFIEMARENGEKGKRTISRKARLQELYKKCRDDSRDWAKELAEKPEEDFRSDRLYLYYTQMGRSMYTGKPIDINQLFDRNVYDIDHIYPQSLTGDDSLDNRVLVEKTVNAKKGDTYPLGSALDGCHIGGQIHIQDIQKEMRPFWHMLLEKGLISKEKYNRLSRTTPLSDTEKAAFIGRQLVETRQSTKACAELLSKAYPQARIVYTKAGNASRFRQYGGFIKVRDMNDYHHAKDAYLNIVVGNVFDTRFTSNPLHFLKGNHPVYSLNTEALYGHKVSRGGVDAWIPAEKDEKGHVMAGHEGTMGTVRKWMRKNNILFTRMPLEGKGGLFDQTIMKKGKGQVPLKGDSPVSDIEKYGGYNKASSAYFVLTSSKLKDETIYTIETIPLIIKRMIQTNKDKEDYIKRHWKAHGKKMVNPHICYGHIPVQSLLEINGFKVHLAGKSGKDFKLRNAEQLCISNDDAAVLKSVLKYNERASSPKRKDALLIGPFDNIREVDVNRLYQVFEDKLTNQVYKVKLGKQASVLKKGEGKFNELPLEVKCRVIGEILHLFQCNAAIADLRLIGGAKNAGALTMNPRVSPEDHVYLIEQSVTGFFEKRILLAPYGGK

SEQ ID NO: 8609 - protein, 1349 aa, unidentified
  REGION 1..1349: note = Description of Unknown:uncultivated organism sequence
MKNEKKSFGEYYLGIDAGTDSVGWAVTDENYNVLKFHGKAMWGVRLFEEAQTAADRRAFRTARRRQGRKVQRTKLLQELFAEEICKKDSAFFIRMADSKYYAEDKTEPQQNALFDDVDYTDKDYHKEYPTVYHLRRAFIEGKDIRDPRLLYLAVHHIINNRGHFLFEGMDLSKVVDFETPFSILKEYLREEDFGFDFSNIDADALKESLKNKQGITQKKKDLYKLLGKEKGTLKSVCDLLAGGSGIKLTDLFNDESLAGETPDKISLSDSSIEDDRTALENILQDRIQLLDCLKAVYDWAILDEILSGSPYISFAKTQSYEKHKKDLALLKKTIKRLCPEKYKEVFKSPNTANNYCAYSGMCVINGKKTAIEKRTTASDFGKYIAKLLSSFDDPDAKDILRQIDAQTFMPKQRTGENSVLPYQVHKVELEKILGNAEMNFPFLLKKDDSNLTVKDKIIKLLTFRIPYYVGPLNDKHRNSGFCWIVRKNTEDTSRILPWEFEQKVDLYASAEQFINRMTNKCSYLVGEDVLPKDSLLYSEYSVLNELNNLKLSGESLAQSDKAEIIDELYKKNNKVKIKDIANYYKRKGFEVKPDDFTGFHEELKSSLRSYNMFFNILRDRFDESAVEAAIKAIVLFGNDKKMLLQKLRSIKNGYFTEEEIKRMAGFKFSDWGRLSEKMLTGIYSVNKETGEAFNIIEALRTTDKNLMQLLSAELDFKKQIDAENEKINGGIPEFSYDALVKDCYASPAVKRSIWQVLTIAKEIEKITGHAPKKIFMETTREDREKKATKSRKKQLVELYKKCREETSELLKTLEKREDSELRNNALYLYYTQMGKCMYSGETIELEHLFDKNVYDIDHIYPQSKTKDDSLNNKVLVKKELNGQKSDRYPVPRDILSPGIENHWKCLRAAGLISEEKYKRLTRRTNFSDTELSGFIARQLVETNQATKAAAEILKRVYPETRLVYSRASNVDVFKKRYDILKVREVNDYHHARDAYLNIVVGNVFDVKFTMNPLNFIKGGGTYSLNENMYDSDIRRGSNVAWVAGNNGTIATVKKTCSKENILFTRYAFEQKGGLFDQQIMKKGKGQLPTKPSDPHMQGQTEQEWIDKYGGYNKLSGAYFCLVEYKDKGKIVRSIESVPLLVSAKIKNDPSDLEKYLKQALGTEELSVRIREIKFNTLFNHNGFLMHITGRQGNQLIFKPALQLKVNASDYAYIKKIVRFCEREKESKKAFTVSGFDGIEKDRNIELFDFFTKKLSSDIFMVHHAATLKSLLANRSIFVDMSVEMQARTIYQILHIFRCNRMLADLTALQGAKSAGTVLMSKKISLNDKIMIINQSPTGLFENSVDLLTV

SEQ ID NO: 8610 - protein, 1379 aa, unidentified
  REGION 1..1379: note = Description of Unknown:uncultivated organism sequence
MMKEIKKIFIGLDMGTNSVGWAATDENYEVIKKNGKALWGIRLFDEAQTAEDRRMHRIARRRIERRSRRIDLLQELFAQEICKKDPGFYERLNESGLYEEDKRVHQTNSLFNDVDFNDKAYYKKYPTIYHLRHALMTENHPFDVRLVYLAIHHILKHRGHFLFENFQTDEKGTSGFDESFAAFGSALDRIKGSSPDVRKADSMKDILKDKKLGVKEKAASLLQCLGQGKEKDFKAMMTLAAGGTASLSDIFNDEKLKDFEKNKVNFSSAQFEENEPDIMVELGDRYDLIAALHGLYNWSLLAELMGEYHYISEAKIAVYDKHKADLKVLKRVLKQRPDIYAKIFREPGSSANKNYSAYVGVCKVKGKKAAIEKCSYEDFTKTLKSCLKDMPDSNDKDYISRELNMGTFLPKSVSKENGVIPYQLHLQELKIILSKAEAYLPFLKVKDQYGTVSDKIISLFTFRIPYYVGPINEHAGSCWVVKKDKRGKVYPWNFTEKIDIEKSAEGFIRNLTNKCTYLIGEDVLPKNSLLYSEFTVLNELNNVKIGETMQKLPLSLKEKVMDNLFSCYKHVSRTKFIKYLVSEGIDKKEAESISGLDGDFKSSLSSLIDMKHILENDFSREDAEKMIQDITIFGGDKKMLKNRLHREFSYLTPEQLTSLTRLSYDGWGRLSREFLVNLLPAEGNNYEVLVDHTSGEVLNIISAMRQTSYNLMELLGSRFGYGQAIEERNRKEEGQGRITYKDVEDLYISPAVRRPLWQALKIVREIVKITGKEPSKIFIEMARENGEKGRRTISRKARLQALYKKCRDDTRDWAKELEGKSEEDFRSDRLYLYYTQMGRSMYTGKPIDINRLFDRNVYDIDHIYPQSLTGDDSLDNRVLVEKTVNAKKGDTYPLSSALDGCYISGQQIRIQDIQKEMRPFWHMLLEKELISKEKYNRLSRTIPLSDAEKAAFIGRQLVETRQSTKACAELLSKAYPQTRIVYTKAGNASRFRQYGGFIKVRDMNGYHHAKDAYLNIVVGNVFDTRFTANPLHFLKGNHPVYSLNTEALYGHKVSRNGVDAWIPAEKDEKGQVIDGHEGTMGTVRKWMRKNNILFTRMPLEGKGGLFDQNIMKKGNGQVPLKGDSPISDIEKYGGYNKASIAYMMLVQAEEKGKPVYLLESIPNYVKNKLTSDKERQEYCVRTWTAQGNKYRHPQILIPKVRIQSLLEIDGFKAHISGKTGNLFVMRNAQELCMDITLARVLKNVLKFIHRKTVQKDAAITEYDGVSDDNTLALYDFFVDKLSSSIYGKKFATQADFLRQSKDKFTNLPLEERCEVLGSILHLFQCNAVLSDFHLLGGSRQAGRIYLNKKIKAQDHVYLIEQSVTGFFEKRILLAPFGEK

SEQ ID NO: 8611 - protein, 1381 aa, unidentified
  REGION 1..1381: note = Description of Unknown:uncultivated organism sequence
MMKELKNYFVGLDMGTTSVGWAVTDENDEIIKKNGKALWGIRLFEEAETAADRRMHRISRRRIERRSRRIDLLQELFAQEICKKDPGFYERLNESGLYEEDKTIHQPNSLFNDVDFNDKAYHKAYPTIYHLRNALMTEDRVFDVRLVYLAIHHILKHRGHFLFDSFQVDENGASGFEECFGAFGNALDRIKGDSLDVSKEDAMKAACRDKKLGVKQKAAALVQCLGRGKDKAFKAMMTLAAGGTASLSDVFEDDGLKDFDKNKVNFSSIQFEENEPDIMAELGDRYDLIAALQGLYSWSLLAELMGDHKYISEAKIELYEKHGKDLKVLKRVLKQSPIDYAHMFKAQGSKKNTNYSAYVGVCKIKGKKVPVEKCGYEDFAKTVKSCLKNLPDSEDKKYIEKELEQGTFLPKAVSKENGVIPYQLHLQELKKILSRAEAYLPFLKEKDKYGTVSDKIISLFTFRIPYYVGPTNEHAKSCWVVKKDKTGKIYPWNFTEKIDVEKTAEGFIRNLTNKCTYLIGEDVLPKNSLLYTEFMVLNELNNVRIGQTMQKLSPELKEKILENLFRKHKHVARKRFINYLAAEGMDRKEAESISGLDGDFKSSLSSFIDMKGILGKDFKREDVERMITDITIFSGDKKMLRTRLHREFSYLSPKQLTSITRLSYEGWGRLSKELLVNLFPAEGDAYEVLADKTSGEVLNIISAMEQTSFNLMELLSSRFGYAKAIEERNREKEGNGTISYRDVEDMYISPAVKRPLWQALKIVREIVKILGKEPSKIFIEMARENGEKGRRTVSRKARLQELYKKCRDDSRDWAKELEERPEEDFRSDRLYLYYTQMGRSMYTGKPIDINQLFDRNVYDIDHIYPQSLTGDDSLDNRVLVEKTVNAKKGDTYPLGRALDGCHIGGQIHIQDIQKEMRPFWHMLYEKEFISKEKYNRLSRTIPLTDTEKAAFIGRQLVETRQSTKACAELLSKAYPDTRIVYTKAGNASRFRQYGGFIKVRDMNDYHHAKDAYLNIVVGNVFDTRFTSNPIRFLKGNHPVYSLNVEALYGHRVGRGGVDAWIPAEKDEEGHTCPGHEGTMGTVRKWMKKNNILFTRMPFEGKGGFFDQNIMKKGKGQVPLKENSPVSDIEKYGGYNKASSAYFVLTSSKLKNETIYTIETIPLIIKRMIQTNKDKEDYIKQHWKDHGKKMVNPHICYGHIPVQSLLEINGFKVHLTGKSGKDFKLRNAEQLCISNDDAAVLKRVLKYNERSSSSKGKEALLITPFDNIQEVDLNRLYQVFEDKLTNQVYKVKLGKQASVLKKGEGKFNELPLEVKCRVIGEILHLFQCNAAIADLRLIGGAKNAGALTMNPRVSSEDHVYLIEQSVTGFFEKRILLAPYGEK

SEQ ID NO: 8612 - protein, 913 aa, unidentified
  REGION 1..913: note = Description of Unknown:uncultivated organism sequence
MKEIKNYFIGLDMGTTSVGWAATDENYEIIKKNGKALWGIRLFDEAQTAADRRMHRIARRRIERRSRRIDLLQELFAQEICKKDPGFYERLNESGLYEEDKTVHQKNSLFNDVDFDDKAYYKEYPTIYHLRYDLMTKDRPFDVRLVYLAVHHILKHRGHFLFDHFQVDENGVSGFEESFAAFGDAFAHIKGESFDMGKEEEMKALCRDKKLGVRHKALALAQCLGRSKDKDFKAMMTLAAGGTALLSEVFKDEGLKDFSKNKVSFSDSQFENDKPEIIAELGDRYDLIAALHGLYNWSFLAELMRGHKYISEAKIEIYDKHKEDLALLKKVLKQDRSVYNLMFKEPGDKKPINYSAYVKACKTNGKKLPLPYGKFKYEEFIKTVKFCLKNLPDSPDKKNIENKLEEGSFLLKAVSVENGAIPYQLHLQELKIILSKAEAYLPFLKVRDQYGTVSDKIISLFTFRIPYYVGPINEHAGSCWVVKKDKQGKVYPWNFTEKIDIEKSAEGFIRNLTNKCTYLIGEDVLPKNSLLYSEFTVLNELNNVRIGENAQKLSPELKEKVLENLFKKHKHVSRRKFINYLATEGIDKKEAESISGLDGDFKSSLSSLIDLTNILGNDFSREDGEQMIKDITIFGGDRKMLKSRLHREFPYLTPEQLTRLIHLSYQGWGRLSKELLVNLLPAEKSTGEVLVDKGSGEVLNIISAMEQTSYNLMELLSSRFGYAKAIEERNREKEGNGTISYQDVEDMYISPAVKRPLWQALKIVREIVKILGKEPSKIFIEMARENGEKGKRTISRKARLQELYKKCRDDSRDWAKELAEKPEEDFRSDRLYLYYTQMGRSMYTGKPIDINQLFDRNVYDIDHIYPQSLTGDDSLDNRVLVEKTVNAKKGDTYPLGSALDGCHIGGQIHIQDI

SEQ ID NO: 8613 - protein, 1345 aa, unidentified
  REGION 1..1345: note = Description of Unknown:uncultivated organism sequence
MGKREFGEYYLGLDVGSNSVGWAATGLDYQLLRFNQKSMWGTRLFDKVDEANPAAVRRIARTQRRRIQRRNQRLALLQDLFQAEVAKVDPGFFQRLSEGMLREEDKSVRQKHTLFHDANYTDADYHRSYPTIYHLREALLTGDQAFDVRLVYLAVHHILKYRGHFLFAGESVDEVLDLGEQLRALAQAMEDEYDVRFVCEDVSQAEQLLKDRTIPMRRKQKQLERIFNAEDREQRQEKAWIKALTGATVKFSEMFPDVDVAGEEEQKVSFSKDNFDEKAPVWQALLGDRFALLDQLHAVYNWSVLADLLRGEKYLSSAKVRVYEKHGEDLKRLKRVIRRYADRETYRKMFSDANEPNNYCAYSGMAMKNGRKVPIKKRCQYDEFAKAVGKLLKPFPEDEDVRQIRQELEQNTFMPRIVSSDNGVIPNQLHCMELREILRRAARYLPFLNEQDADGLSVSDKVMQIMKFRIPYYVGPLNPASANSWVVRRSRERIYPWNFEQVVDTEASAEAFITRMTNNCTYLKNEDRADEQKVLPEDSILYSRFKVLNELNNLRICGEPVSVELKQEIYRDLFEKRRQVKRAKLVEYLRQRGIHVSDEDIGGLNGDFKSSLKSEIAMKKALGPAYTEEMAEEILRLNAIFGDDRKLLRRRIDRSFGKALSEEQIRAAMAVKSNGWGRLCAAFLTRIVHFDPEQERSYNIITALWETNENLMRLLSGAYTFQEQVNAWNAGGTDVDMDHRLVEELYASAPVKRQIWQAMKVVREVVKITGHAPRRLFIEMARGEDERKEIKESRKRQLLALYERIQDEQRDWVTEIGNQWEERDFRRDALYLYYTQMGRCMYTGEPITLSDLFNQNLYDIEHIYPRSLVKDDSIDNRVLVKKQINLKKANKYPLDAGIRNRCRDFWRLLNARGLISDAKLQRLLRTQGFSETEREGFIARQLVETRQSTKALADILKQALPEAEIVYVKAGNVSEFRQKYEFVKVREINDLHHAKDAYLNIVVGNVYHTRFTADIRGFVQRNEHYNFRKMYEFNVQRGGCTAWRAGDSGTIVTVRRMMAKNNILVTKQVQARQGKLFHVKLDAKKSGLLPRKAGLPSELYGGYNHVNVSYLMLVEHTQENIRCRSLVSVPIHLSAQLGDDEQKLVAYCRQQGYEEPKLLIKRILMNSLISVNGSLGRLMSKTNKSLFLSNARQLHLSIPMEAYFKRVIRFCERAAISQKLHPNQPIQVNAMDGISQEENISAYVELWQKMEKLHGRLLKRLVNKLKNAQPAFQHLNIERQCYVLKQILQLWTESSSQTADLRDIGLSKDTGAISINSKISEYSEVTLFLQSVTGLFDEPVNLLKP

SEQ ID NO: 8614 - protein, 1345 aa, unidentified
  REGION 1..1345: note = Description of Unknown:uncultivated organism sequence
MGKREFGEYYLGLDVGSNSVGWAATGLDYQLLRFNHKSMWGTRLFDKVDEANPAAVRRIARTQRRRIQRRNQRLALLQDLFQAEVAKVDPGFFQRLSEGMLREEDKSVRQKHTLFHDANYTDADYHRAYPTIYHLREALLTGDQAFDVRLVYLAVHHILKYRGHFLFAGESVDEVLDLGEQLRALAQAMEDEYDVRFVCEDVPQAEQLLKDRTIPMRRKQKQLERIFNAEDREQRQEKAWIKALTGATVKFSEMFPDVDVAGEEEQKVSFSKDNFDEKAPVWQALLGDKFALLDQLHAVYNWSVLADLLRGEKYLSSAKVRVYEKHGEDLKRLKRVIRRYADRETYRKMFSDANEPNNYCAYSGMAMKNGKKVPIKKRCQYDEFAKAVGKLLKPFPEDDDVRQIRQELEQNTFMPRIVSSDNGVIPNQLHCMELREILRRAARYLPFLNERDADGLSVSDKVMQIMKFRIPYYVGPLNPASANSWVVRRSRERIYPWNFEQVVDTEASAEAFITRMTNNCTYLKNEDRADEQKVLPEDSILYSRFKVLNELNNLRICGEPISVELKQEIYRELFEKRRQVKRAKLVEYLRQRGIHVSDEDIGGLNGDFKSSLKSEIAMKKALGPAYTEEMAEEILRLNAIFGDDRKLLRRRIDRSFGKALSEEQIRAAMAVKSNGWGRLCAAFLTRIVHFDPEQERSYNIITALWETNENLMRLLSGAYTFQEQVNAWNAGGTDVDMDHRLVEELYASAPVKRQIWQAMKVVREVVKITGHAPRRLFIEMARGEDERKEIKESRKRQLLALYERIQDEQRDWVTEIGNQWEERDFRRDALYLYYTQMGRCMYTGEPITLSDLFNQNLYDIEHIYPRSLVKDDSIDNRVLVKKQINLKKANNYPLDAGIRNRCRDFWRLLNARGLISDAKLQRLLRTQGFSETEREGFIARQLVETRQSTKALADILKQVLPEAEIVYVKAGNVSEFRQKYEFVKVREINDLHHAKDAYLNIVVGNVYHTRFTADIRSFVQRNEHYNFRKMYEFNVQRGGCTAWRAGDSGTIVTVRRMMAKNNILVTKQVQARQGKLFDVKLDAKKSGLLPRKAGLPSELYGGYDKVKVSYLMLVEHTQENIRCRSLVSVPIHLSAQLGDDEQKLVAYCRQQGYEEPKLLIKRILMNSLISVDGMLGRITAKSDDYLVLCNAQQLHFPMATEVYFKKIVRFCERAATAQKFHPDQPIQVNAMDGLSAEGNLAAYIALYEKLEKLHGRILSDLVKKLKEAQPAFQQQNMARQCYVLKQILRLWSASSRQTADLKDVGLSGHTGTIRVNSRISEYSEVLLIFQSVTGLFEEAVDLLKI

SEQ ID NO: 8615 - protein, 1371 aa, unidentified
  REGION 1..1371: note = Description of Unknown:uncultivated organism sequence
MEANEYHGDYYLGLDCGTTSVGWAVTDTDYNVLTFNGKRMMGVRLFDEAKTAADRRMARCSRRRTMRRKERLNILQDLFAEEIDKVDPLFFRRLENSKYFREDKDVDCKYALFGDKEYTDSEYFRDYPTIFHLRYELMNSREYHDPRLVYLAIHHILKNRGHFLFPGENMKAVTDASELLKNTENLINQIFSCDDEDFSFVFGDLSEFQETFRIRRPSERKEKMSAACSCTDKKIGDSIIKLINGNKVPLKNLFVLEEDSELFKESVCFKDSDFEDARLPMLEGLLNDDDRTMLLISLKAIYDYILLADILDGCSSVSEGKIRQYAENRKDLASLKYIFRKYLSEQEYEDYFHSEKKGCFSNYIGVIQDNRTGKKTLRRCSYDEFRKNTAGLLKKISAEECDESIVNALSEKLETESFLPLLISSRNSVIPYQLHKMELEAILANASQYLPFLNEKDESGYSVSEKIVMLLTFRIPYYVGPITNSHSSDEQKKYSWLVRREDGKVYPWNFDQKIDRSASAELFINRMKSHCTYLPDFLVIPRNSLLYSKFMVLNEINKLTINGNQITVKQKQDIFDDLYRRNRKVSSKMIKDYAVSKGWASKPVSLGGIDGEPKASLASYYDFRDIIELKRLEWSKVEEIIEKITLFGDDRSMCLEAISRIAGEALDKDEISEIAKRRYTGWGRLSREFLVGLQAESSRTGEITSIISLLWNTNSNLMEIINDPEYRITDQLKGQAIDKLDYKLVDELYVSPSVKRQIWQTLKVCQELEKVMKRAPAKVFVEVARGDSENSGRTKSRKQALQELYESIRKEGLFKEEIDELSASLDKYSEQDISRQDKLYLYFTQMGRCMYSGERIDIESLYDTNIYDIDHIFPQSLTADDSLSNRVLTLKRLNLLKSNKVPIPEEWRSRMADYWKILAKKELISKEKYRRLTRSEPLSDDELQGFINRQLVEVSQSTKATIDILRRYYGETTSVVFAKARNVSYFRQRFSIPKARCLNDLHHAKDAYLNIVVGNTYTTKFTSNFWKYISDSRTSSESSTSSNIPTWKYNLMKMFDWTVEGAWYPGLTGTIVTVKKECWNDDVRLTKQVSEISGALFDLQLVKGNVAEGLTPAKKITDENISADEWTKRYGGYNKQAVSYFIIAEHKNKKKRDISIFPAYCSMKGNLKTKSEIEQFLIQQHNVEEPRIIIPKLMINDLIEYKGMKMRISGKSSSGILVRMEVPLRCCWFVEDYIHKIEKAFQLKQKNKLSYLPYNRNEISSEYNIMLYDFLTMKAGNPSYINRPSCQCGVLQKGHEKFEGLSIDEQLNVLQNIIRYFSSAPGMNDFSAIGGSANAGQLKFSKTVRTKGAGPKFVVIHQSITGLFEKRTVVK

SEQ ID NO: 8616 - protein, 1079 aa, unidentified
  REGION 1..1079: note = Description of Unknown:uncultivated organism sequence
MLLISLKAIYDYILLADILDGCSSVSEGKIRQYAENRKDLASLKYIFRKYLSEQEYEDYFHSEKKGCFSNYIGVIQDNRTGKKTLRRCSYDEFKKNTSGILKKIKADECDVDILKELSEKLETESLLPLLISSRNSVIPYQLHKMELEAILANASQYLPFLNEKDESGYSVSEKIVMLLTFRIPYYVGPITNSHSSDEQKKYSWLVRREDGKVYPWNFDQKIDRSASAENFINRMKSHCTYLPDFLVIPRNSLLYSKFMVLNEINKLTINGNQITVKQKQDIFDDLYRRNRKVTSKMIKDYAVSKGWASKPVSLGGIDGEPKASLASYYDFRDIIELKRLEWSKVEEIIEKTTLFGDDRSMCLEAISRIAGEALDKDEISEIAKRRYTGWGRLSREFLVGLQAESSRTGEITSIISLLWNTNSNLMEIINDPEYRITDQLKGQAIDKLDYKLVDELYVSPSVKRQIWQTLKVCQELEKVMKRAPAKVFVEVARGDSENSGRTKSRKQALQELYESIRKEGLFKEEIDELSISLDKYSEQDISRQDKLYLYFTQMGRCMYSGERIDIESLYDTNVYDIDHIFPQSLTADDSLSNRVLTLKRLNLLKSNKVPIPEEWRSRMADYWKILAKKELISKEKYRRLTRSEPLSDDELQGFINRQLVEVSQSTKATIDILRRYYGETTSVVFAKARNVSYFRQRFSIPKARCLNDLHHAKDAYLNIVVGNTYMTKFTSNFWKYISDSRTSSESNISSNIPTWKYNLMKMFDWTVDGAWYPGLTGTIVTVKKECWNDDVRLTKQVSESSGALFDLQLVKGNVAEGLTPAKKITDENISADEWTKRYGGYNKQAVSYFIIAEHKNKKKRDISIFPAYCSMKGNLKTKSEIEQFLIQQHNVEEPRIIIPKLMINDLIEYKGMKMRISGKSSSGILVRMEVPLRCCWFVEDYIHKIEKAFQLKQKNKLSYLPYNRNEISSEYNIMLYDFLTMKAGNPSYINRPSCQCGVLQKGHEKFEGLCIDEQLNVLQNIIRYFSSAPGMNDFSAIGGSANAGQLKFSKTVRTKGAGPKFVVIHQSITGLFEKRTVVK

SEQ ID NO: 8617 - protein, 1389 aa, unidentified
  REGION 1..1389: note = Description of Unknown:uncultivated organism sequence
MAEVKKQAAKEYYLGLDMGTDSVGWAVTTPDYEVVKKSGKALWGIRLFDAANTAAERRMMRTARRRTHRRAHRIDLLQELFAPEISKVDPGFFARLDESRLWQEDKAVDQPYSLFNDKDFNDISYHKKYPTIYHLRYALMTSDRPFDVRLVYLAIHHIIKHRGHFLFENLKPGEEGSSGFPETFQAFLNEMKEELDIDIDPSKRDSLKSILKDTGITISEKSKKVLSCFGDTRNKSLKAAASLMSGGSASISDLFGDESLKESEAKQVSFSASNYEEKEPVLQGDLGDRFELILVLKGLYDWARLAELMGDSKTISEAKIKVYEKHKKDLKILKKLIRSVSYKDYYKTFKDVGPKSYSCYVGVCKVKGEKKVIPKRCPQDEFYKEITGVIEKADDSEDKAYALHEKETKNFLPLSVERINSHIPYQLHEQELKIILEKAEKYLPFLKEKDQYGTVSSKILQLLTFRLPYYIGPLSENSPNHWFVRKDKEGHIYPWNFSEKVDEAQSAENFIVKMTNTCTYLLGEKVLPKNSLLYTEFMVLNELNNVRAGAAGEKLNPDLKEAAWNELFLKSKKVTQKGLIRFLIRHRWEEKEAKIIQGIDGDFKSSLAPWIDMKKILGDSFDKDLAERIIKDITLFGMDRKMLRKRLENFDVKLTSNQIKELLRLKYSGWGRLSEKFLTGILPVIGKNVEPLVDEATGEVMNIITALRKTNLNLMEILSDAHGFSAAISRENEGKLGETLTYKTVEDLAISPAVKRPVWQSLKIIREICHIMGGSPSRIFIEMARDPNGANEKKRTVSRKDRLLALYKNCKDDTRNWAEEISKYSDSDLRSDRLYLYYTQMGKSMYTGKPIDINSLSDRNIYDIDHIYPQSKTADDSLDNRVLVERSVNGRKSDDYPLSEEVHTRMKPFWDYLLKSGLISKRKYDRLVRNTPLSDDELAAFIGRQLVETRQSTKAVTEILKNIFPDTTIVYAKAGITSRFRQYGNFVKVRDINDFHHAKDAYLNIVVGNVYYTKFTANPLNFIHGDSPRYSLKDEVLYRYPVIRNGKTAWVPGEEGTMAVVRKWMNKNNILFTRMTYMGHGGLFDQKLMKKGKGQVSIKEKGAIANINKYGGYNKATTAYLMYVEGQDAKGKKVYVLENVPLYLKDKLTSIKDKEVYCDKLWNQGKDQKKKITHIKVLIDEIPLQSLISINGFKFHITGRTGTSYSVKSAEELVLDPNDAEILKSVLKFTERFRIATAKAKKDKNSGPLDVALQLTSYDWTKSGRNTELTPEKAAEMREKDLIHLYDVFLNKLTSFYGRAFHAQISVLQNGREKYEGLPPEWKCVVLSEILHLFQCDRVLADLTLIGGSSQAGALKFSKNLKPDNQPMLITQSVTGFFEKKISLAPYRK

SEQ ID NO: 8618 - protein, 1371 aa, unidentified
  REGION 1..1371: note = Description of Unknown:uncultivated organism sequence
MKNKNDYYIGLDISTHSNGWAVTDENYNIIKRNGKSLWGTRLFDEAKTAKERKTLRAARRRLERRSWRIKLLQELFAQEICKKDPGFYVRMKESGFHKEDKTIHQPNSLFNDINFNDKAYHSAYPTIYHLRYALMTEDKAFDVRLVYLAIHHIMKHRGHFLFANLKTDEKGIALFEESFNAYCNVVERIFGDSLKTDKVENIKDLFKNKDLSKAKKEKALLECLDKVGDKRYKAMVTLAVGGTAQLSTVFNDENLKEKESSTTSVCFAKEDYESKEPEIMDKLGERFDLIAALHDLYNWSLMAQIMKGHKFISEAKIENYDNHKSDLAVLKRVFKQNPEAYAHMFKEPGGKKEKANYSAYVGLCKVKRSKTPITKCSYEEFITELKKRLEQFPSSEDKEYIKQRIKNGEFLRKAVNKENSIIPYQLHLQELKNILTKAERYLPFLKEKDEYGTISDKIISLFTYRIPYYVGPMNEHANHCWIVKKDKNGRVLPWNFNEKIDTENTAEKFIRSLTNKCTYLVGEDVLPKNSLLYTKFTVLNELNSVKIGRNLQKLDEELKAKVLKNLFMVYKHVTKREFVTYLLTEGYNRDEIEPVNGIENGFNSNLGPWIDLKKIMGESFNYKDGEQIIRDITIFGNDKNMLKSRIHRMYPSLSSKQVENLSSLSYQGWGKLSKELLLNVIAEPGEKHEMLVDKATGKALNIISAMEKYPLNFMELLSDRYGYTKAIEEKNKGRWGEGEITYEDVEALHVSPAVRRPLWQAMKIIREIVKIMGREPTRIFIEMTRGDGVNGKATVSRKDKLLELYKKCKDDTRDWVKELGTQENEDFRSDKLYLYYTQMGRSMYTGKPIDINELFNKNMYDIDHIYPQSFTGDDSLDNRVLVEKAVNSKKDAVYPLGDALNGCHIPWQNIHIEDVQKEMKPFWEMLCDKGFISKEKYKRLIRTTPLTNEEKAAFIGRQLVETSQSTKTCAELLSRAYPNTKIVYSKASNVSRFRQYGDFIKVSTMNDFHYAKEAYLNIVVGNVFYTKFTSSPLNFLKEKNSVYTLNTRSLYSRKISRGGVDAWIPPQKDKEGNIIPGHEGTMSTVRKWMSKNNILITRMTFEGKGGLFNQTIMKKGEGKLPLKGKLPLSDMSKYGGYTGVSLAHISLVRAKKGKKTVYMFESVPVYCAKTLKTKEDYVAYFKKVWKEENKDYEDLEILIPIIPLQSLIEVNGFKMHISGKNGNGYSVKNAQELCADNSFVAVLKKALKYNLLEQGEISDEEVLYLYDFFIDKLQNTIYSKKFDGIAKKLSSKRSKFSSLKLKDKCKVLKEVLQLFQCNSSSANLTALGCADRTGLLTIGKNISEKDHVYLIEQSITGFYEKRILLNPYEGK

SEQ ID NO: 8619 - protein, 1393 aa, unidentified
  REGION 1..1393: note = Description of Unknown:uncultivated organism sequence
MAEVKKQAAKEYYLGLDMGTDSVGWAVTTPDYEVVKKSGKALWGIRLFDAANTAAERRMMRTARRRTHRRAHRIDLLQELFAPEISKVDPGFFARLDESRLWQEDKAVDQPYSLFNDKDFNDISYHKKYPTIYHLRYALMTSDRPFDVRLVYLAIHHIIKHRGHFLFENLKPGEEGSSGFPETFQAFLNEMKEELDIDIDPSKRDSLKSILKDTGITISEKSKKVLSCFGDTRNKSLKAAASLMSGGSASISDLFGDESLKESEAKQVSFSASNYEEKEPVLQGDLGDRFELILVLKGLYDWARLAELMGDSKTISEAKIKVYEKHKKDLKILKKLIRSVSYKDYYKTFKDVGPKSYSCYVGVCKVKGEKKVIPKRCPQDEFYKEITGVIEKADDSEDKAYALHEKETKNFLPLSVERINSHIPYQLHEQELKIILEKAEKYLPFLKEKDQYGTVSSKILQLLTFRLPYYIGPLSENSPNHWFVRKDKEGHIYPWNFSEKVDEAQSAENFIVKMTNTCTYLLGEKVLPKNSLLYTEFMVLNELNNVRAGAAGEKLNPDLKEAAWNELFLKSKKVTQKGLIRFLIRHRWDENEAKIIQGIDGDFKSSLAPWIDMKKILGDSFDKDLAERIIKNITLFGMDRKMLRKRLENFDVKLTSNQIKELLRLKYSGWGRLSKKFLTGILPVIGKNVEPLVDEATGEVMNIITALRKTNLNLMEILSDAHGFSAAISRENEGKLGETLTYKTVEDLAISPAVKRPVWQSLKIIREICHIMGGSPSRIFIEMARDPNGANEKKRTVSRKDRLLALYKNCKDDTRNWAEEISKYSDSDLRSDRLYLYYTQMGKSMYTGKPIDINSLSDRNIYDIDHIYPQSKTADDSLDNRVLVERSVNGRKSDDYPLSEEVHTRMKPFWDYLLKSGLISKRKYDRLVRNTPLSDDELAAFIGRQLVETRQSTKAVTEILKNIFPDTTIVYAKAGITSRFRQYGNFVKVRDINDFHHAKDAYLNIVVGNVYYTKFTANPLNFIHGDSPRYSLKDEVLYRYPVIRNGKTAWVPGEEGTMAVVRKWMNKNNILFTRMTYMGHGGLFDQKLMKKGKGQVSIKGEGAISDINKYGGYNKASTAYLMYVEGEKSNGSPAYVFETVPLYLADKLKTISDKEKYCEELWKNESDKNYKFTHPKVLIGQIPIQSLISLNGFRLCITGRTNNQYVLKSSEELVLSNQNVRILKALLKFVTRLQTAESLVKHSNNKKNESKSEPAIKLTSFDWTEENRIKTISLAEAEKQRNQDMLQLYDVFLDKLSNGIYGKRLGKQADVLSNGRETFVEMIPEEKCKLLAEILHLFQCGRVPANLKPIGGAASAGLHIMNKRLDPKEHPELIVQSVTGFFEKKIPLAPYRK

SEQ ID NO: 8620 - protein, 1347 aa, unidentified
  REGION 1..1347: note = Description of Unknown:uncultivated organism sequence
MSRDKSKFEKYYLGLDIGTDSVGWCVTDPDYNVLKFNGKAMWGIRLFDEASSAADRRAFRTNRRRLQRRKQRIALVEELLNEEISKVDPLFFIRIKESFFREEDKKEAVRQRYSIFSDAKYTDIDYHREFPTIFHLRHALMLHEQPYDIRLYYLAISHFMKHRGHFLFAGDISEATSFETVYRGLMDYIAENMEDISFSCTDTGKVQRLLTDRTTGRAEKKRIINGLFNEGKNTVQQKEILATLCGATVSLEKLFDDERLKDTEVPKFSFADGIDDDKETKLANALGERFELIVRMKAVYDWAVLTRILSGSKSISQAQVNSYTKHREDLKLLKKLVRKYIPNEYKEVFTDLSVSNNYAAYVGHVSANKKAFKVKRMTEQKDFCDYIRKKFAKVDSNDDELIRMRDELEKGTFMPKQVMKSNSAVPYQIHRQDLRKILDNMGVDYPSLSKKDETGLSSCEKIMKIFEFRIPYYVGPLNGYHSDKGGNSWVIRKRSGRVTPWNFQDMVDTKASAEAFMRRLTNKCTYLIGEDVLPKDSLMYSKYMVLNELNNVRINGNRIDVNTKQRIYKELFRDKSAQLSLNKLQDWLIKENIAEKDDQLSGIDKTFKAKLKSYHDFYKIIGTRVDTEPVMVDDIICNILIFGEDKRLLKERLHEKYGDILTQDEIKMISKLTYSGWGRLSYKFLNEIRAVDRETGELRTIIQAMWDGQENLMELLDSKHGYMDEVSKVNAEVEGRTREISYDLVSESYASPAVKRGIWQTLQVVKEIQKVTGHDPARVFVEVARSKETNPTRKDSRKERLISAYKSIQDETRDWINEINEKEERSFASKKLYLYYTQMGRDMYSGKPIDLDELMTTDTYDIDHIFPQSKTKDDSIINNLVLVRSEYNRDKSDVYPIPSKYRQEELWKMLEKHGLISEEKYARLIRRNGLSDEELAGFIGRQLVETRQTTKVVTQILGQTMPDTKVVYSKANAVSDFRKDNGFIKCRSVNDYHHAKDAYLNIVVGNVYYTKFTDNPMNFIHNANKPGSNEKYSLNHMYDYDVIRGGITAWKRGEDGSISTVRKYMNKNNILFTRYASEKRGGFYDQMLLKKGDGDLLPIKNKDTRYDTSIYGGYKNPSINHFMLVESDGKKGRKRTIEGVPVYLSGASIDRLERFCSQKLGLVNPIIRYLNIKINSLLKIEGYPMHLSGKSNARIVIKNAVQLCIEREQEDLIRRIDKVAERIREDKNYKVDEHDGITDDDMVRIYDTLYEKTKGIYKKRHSSQISILENGRETFVSMTIEDKIKQLLEILHLFQCNAVSSDLSKIGGASRAGVLVVGNEVSKYSDVRLITQSPTGLFEKEIDLLTV

SEQ ID NO: 8621 - protein, 1389 aa, unidentified
  REGION 1..1389: note = Description of Unknown:uncultivated organism sequence
MAEVKKQAAKEYYLGLDMGTDSVGWAVTTPDYEVVKKSGKALWGIRLFDAANTAAERRMMRTARRRTHRRAHRIDLLQELFAPEISKVDPGFFARLDESRLWQEDKAVDQPYSLFNDKDFNDISYHKKYPTIYHLRHALMTSDRPFDVRLVYLAIHHIIKHRGHFLFENLKPGEEGSSGFPEAFQAFLNEMKEELDIDIDPSKRDSLKSILKDTGITISEKSKKVLSCFGDTRNKSLKAAASLMSGGSASISDLFGDESLKESEAKQVSFSASNYEEKEPVLQGDLGDRFELILALKGLYDWARLAELMGDSKTISEAKIKVYEKHKKDLKILKKLIRSVSYKDYYKTFKDVGPKSYSCYVGVCKVKGEKKVIPKRCPQDEFYKEITGVIEKADDSEDKAYALHEKETKNFLPLSVERINSHIPYQLHEQELKIILEKAEKYLPFLKEKDQYGTVSSKILQLLTFRLPYYIGPLSENSPNHWFVRKDKEDHIYPWNFSEKVDEAQSAENFIVKMTNTCTYLLGEKVLPKNSLLYTEFMVLNELNNVRVGAAGEKLNPDLKEAAWNELFLKSKKVTQKGLIRFLIRHGWEEKEAKIIQGIDGDFKSSLAPWIDMKKILGDSFDKDLAERIIKDITLFGMDRKMLRKRLENFDVKLTSNQIKDLLRLKYSGWGRLSEKFLTGILPVMGKNVEPLVDEATGEVMNIITALRKTNLNLMEILSDAHGFSAAISRENEGKLGETLTYKTVEDLAISPAVKRPVWQSLKIIREICHIMGGSPSRIFIEMARDPNGANEKKRTVSRKDRLLALYKNCKDDTRNWAEEISKYSDSDLRSDRLYLYYTQMGKSMYTGKPIDINSLSERNVYDIDHIYPQSMTADDSLDNRVLVERSVNGRKSDDYPLSEEVHTRMKPFWDYLLKSGLISKRKYDRLVRNTPLSDDELAAFIGRQLVETRQSTKAVTEILKNIFPDTTIVYAKAGITSRFRQYGDFVKVRDINDFHHAKDAYLNIVVGNVYYTKFTANPLNFIHGDSPRYSLKDEVLYRYPVIRNGKTAWVPGEEGTMAVVRKWMNKNNILFTRMTYMGHGGLFDQKLMKKGKGQVSIKEKGAIANINKYGGYNKATTAYLMYVEGQDAKGKKVYVLENVPLYLKDKLTSIKDKEVYCDKLWNQGKDQKKKITHIKVLIDEIPLQSLISINGFKFHITGRTGTSYSVKSAEELVLDPNDAEILKSVLKFTERFRIATAKAKKDKNSGPLDVALQLTSYDWTKSGRNTELTPEKAAEMREKDLIHLYDVFLNKLTSFYGRAFHAQISVLQNGREKYEGLPPEWKCVVLSEILHLFQCDRVLADLTLIGGSSQAGALKFSKNLKPDNQPMLITQSVTGFFEKKISLAPYRK

SEQ ID NO: 8622 - protein, 1348 aa, unidentified
  REGION 1..1348: note = Description of Unknown:uncultivated organism sequence
MSSKKEKFQNYYLGLDIGTDSVGWCVTDPDYNILKFNGKAMWGIRLFDEATPASERRGFRTNRRRLKRRRQRIALLEELLSDEICKVDPAFYMRIKESFFIEEDKREEVRQKYSIFADSKYTDVEYHREFPTIYHLRCALMRHEHKYDIRLYYLALANFMKHRGHFLITGDVSEATSFEKVYESLTEYIDDNLEDISLSCADIGEVKALLCDKKAGKTEKKRRINELYNDGKNSPQIKEILASLCGAKVSLNVLFNDENLKEADVPKFSFSDGIDDDKDDKEEKLSTELGERYELIVRLKAVYDWSVLTNILEGCDSISDAQVKSYEKHGSDLKLLKQMTRLYIPEEYKEIFTDTSVPSNYAAYVGHTSGKGQTFKVERKVEQRDFCDYIKKKFADVESDDKRLMKMRNDIEKGTFMPKQVMKSNNAVPYQLHRQDLRVIIDNMGLDYPELAVKDESGLSVCDKILKIFEFRIPYYVGPLNGSHSGKGGNSWVIRKAKGRVTPWNFEDMVDTKASVEAFIMRLTNKCTYLTGEDVLPKDSLIYSRYMVLNELNNVRINGSRLDVAIKQRIFDELFKRRATQLSLNKLKDWMIKENIVESEDQISGIDVTFKAKLKSYHDFYRIIGTKVDTDPVMVDGIIKNLLIFGDDRAMLRGIISEKYGDRLSAEEIKKICRLKYTGWGRLSYKLLNEISDVDHETGELKTIIQAMWDGQENLMELLSSEHGYMESIRQINAAAKGYGTDICYDLVHESYASPAVKRGIWQTLLIVREIRKVTGYDPSRVFVEVARSKENDSRRKESRKSRLLALYKNIKDESHDWVKEIDVHEDRDFASKKLYLYYTQMGRDMYSGESIELDELMTDTYDIDHIFPQSRTKDDSIINNLVLVRSKYNRDKSDAYPIPDKYRQESLWKLLESKGLISKEKYARLVRREKLSDEELAGFIGRQLVETRQSTKVVTQILEQTMPDTKIIYSKANVVSDFREENQFIKCRSVNDYHHAKDAYLNIVVGNVYFTKFTNDPLKYIKDSKIHGENERYSLKHMFDYDVKRGNVTAWVAGEDGSIATVRKHMGRNNILFTRYATEKRGGFYDQKLLKKGSGDLVPIKGKDVRYDVEKYGGYNKPGINYFMLVESDGKKGRIRTVEGVPVYLNNASDEELKQFYTAKGLKNPTICYREIKINSLIRIDGYPMHISGKTGTRISIKNAVQLCVSSDMERIIHNIEKTMDKMKENKKYIMNEHDKITDADLVEVYDTLSLKLHTIYAKRQSAQISILEGGREKFLLLSPEDKCRQIAEILHLFQCNTVTSDLSKIGGASNAGDLKVGNKVSRYSEAKIIAQSPTGLFEQEIDLLTI

SEQ ID NO: 8623 - protein, 1393 aa, unidentified
  REGION 1..1393: note = Description of Unknown:uncultivated organism sequence
MAEVKKQAAKEYYLGLDMGTDSVGWAVTTPDYEGVKKRGKALWGIRLFDAANTAAERRMMRTARRRTHRRAHRIDLLQELFAPEISKVDPGFFARLDESRLWQEDKAVDQPYSLFNDKDFNDISYHKKYPTIYHLRYALMTSDRPFDVRLVYLAIHHIIKHRGHFLFENLKPGEEGSSGFPETFQAFLNEMKEELDIDIDPSKRDSLKSILKDTGITISEKSKKVLSCFGDTRNKSLKAAASLMSGGSASISDLFGDESLKESEAKQVSFSASNYEEKEPVLQGDLGDRFELILVLKGLYDWARLAELMGDSKTISEAKIKVYEKHKKDLKILKKLIRSVSYKDYYKTFKDVGPKSYSCYVGVCKVKGEKKVIPKRCPQDEFYKEITGVIEKADDSEDKAYALHEKETKNFLPLSVERINSHIPYQLHEQELKIILEKAEKYLPFLKEKDQYGTVSSKILQLLTFRLPYYIGPLSENSPNHWFVRKDKEGHIYPWNFSEKVDEAQSAENFIVKMTNTCTYLLGEKVLPKNSLLYTEFMVLNELNNVRAGAAGEKLNPDLKEAAWNELFLKSKKVTQKGLIRFLIRHRWDENEAKIIQGIDGDFKSSLAPWIDMKKILGDSFDKDLAERIIKNITLFGMDRKMLRKRLENFDVKLTSNQIKELLRLKYSGWGRLSKKFLTGILPVIGKNVEPLVDEATGEVMNIITALRKTNLNLMEILSDAHGFSAAISRENEGKLGETLTYKTVEDLAISPAVKRPVWQSLKIIREICHIMGGSPSRIFIEMARDPNGANEKKRTVSRKDRLLALYKNCKDDTRNWAEEISKYSDSDLRSDRLYLYYTQMGKSMYTGKPIDINSLSDRNIYDIDHIYPQSKTADDSLDNRVLVERSVNGRKSDDYPLSEEVHTRMKPFWDYLLKSGLISKRKYDRLVRNTPLSDDELAAFIGRQLVETRQSTKAVTEILKNIFPDTTIVYAKAGITSRFRQYGNFVKVRDINDFHHAKDAYLNIVVGNVYYTKFTANPLNFIHGDSPRYSLKDEVLYRYPVIRNGKTAWVPGEEGTMAVVRKWMNKNNILFTRMTYMGHGGLFDQKLMKKGKGQVSIKGEGAISDINKYGGYNKASTAYLMYVEGEKSNGSPAYVFETVPLYLADKLKTISDKEKYCEELWKNESDKNYKFTHPKVLIGQIPIQSLISLNGFRLCITGRTNNQYVLKSSEELVLSNQNVRILKALLKFVTRLQTAESLVKHSNNKKNESKSEPAIKLTSFDWTEENRIKTISLAEAEKQRNQDMLQLYDVFLDKLSNGIYGKRLGKQADVLSNGRETFVEMIPEEKCKLLAEILHLFQCGRVPANLKPIGGAASAGLHIMNKRLDPKEHPELIVQSVTGFFEKKIPLAPYRK

SEQ ID NO: 8624 - protein, 1342 aa, unidentified
  REGION 1..1342: note = Description of Unknown:uncultivated organism sequence
MSREKTKYEGYYLGLDIGTDSVGWCVTDPEYNILKFNGKAMWGIRLFDEATQAADRRAYRTSRRRLHRRKQRVALLEELLAEEVCKVDPLFFMRMKESFFREEDKKIDVRQRYSIFSDSNYTDADYHHEFPTIYHLRLALMQHSRKYDIRLYYLALHHFMKHRGHFLLNGDVSEARSFDVVYTSLCDYIEDNMEGLAFDCNNMEDVKNLLCDRKAGKAEKKRQISEMYNGGRNSVQQKEILASLCGASVSLEKLFSDESLKEGEITKFSFADGIDDDKEEKLETVLGERFELIARLKAIYDWTVLSRILEGSDSLSEAQVKSYDKHKNDLCLLKRLVRKYIPKEKNEIFSDLSIPNNYAAYVGHTSVKGKPITARRATEQADFCDYIKKKFSSIDAADPELDRMKEELDKGIFMPKQVMKSNSAVPYQIHRQDLEKIIDNMGKDYPNLAKKNTDGLSICNKILKIFEFRIPYYVGPLNGYHSDKGGNSWVIRRNSGRITPWNFEEMVDTKASAEAFIMRLTNKCTYLTGEDVLPKDSLSYSKYMVLNELNNIRINGVRLNVEIKQRIFDELFKKRNGQMSLKSLKKWMEKENLAEADDQLSGVDETFKAKLKSYHDFYKIIGSRVDTEPVMVESIIRNILIFGEDKRLLKGRIKEKYGDKLSDDEIKQMMKLSYTGWGRFSWKFLNEVNDADNETGEIKTILQAMWDGNENLMELLSSDHGYMDEIRNINASVEGRSEDIRYDLVKETYASPAVKRGIWQTLLIVKEIQKVTGYDPARVFVEVAREKEKNPQRKESRQTRLMALYKNIKDEVRDWQKEIGEHAERDFASKKLYLYYTQMGRDMYSGKQIDLDDLMTDTYDIDHIFPQSKTKDDSILNNLVLVKSEYNRDKSAAYPIPSQYRQESLWKMLRDKELITKEKYERLVRREPLSDEELAGFIGRQLVETRQTTKVVTQILEQTIPDAKIVYSKANNVTEFRKYNGFIKSRSVNDYHHAKDAYLNIVVGNVYYTKFTDNPLRYIRDGKAAEYSLNKVFDFDVSRGETKAWVKGETGTISTVRKYMRKNNILFTRYATEKRGGFYDQMMLKKGSGQLVPIKGKDMRYDTNNYGGYNKPGINYFMLVESDGKKGRKRTLEGVPVYLNGTSDEQLKLFCEEDLGLVNPEIRFREIRINSLLKVDGYPLHVSGKSNARILVKNAVQLCLSQNEEELVHKIDKVLDRIQDNKKYVIDNHDNIDENDLICLYDTLFGKLNKIYKKRHSVQLPVVESGREKFLEMDITAKCKFIREFLHLFQCNAVASDLSGIGGASHAGVLVIGNEISKLSDVRLITQSSTGLFETEIDLLTV

SEQ ID NO: 8625 - protein, 1242 aa, unidentified
  REGION 1..1242: note = Description of Unknown:uncultivated organism sequence
MTSSEPHDVRLVFLALHHILKHRGHFLTSGEIGELGGNLENSYSQLLSALLDDFSVDLSPNLAEPIKQILINKTIRRSEKLDALVDLMDREEEIIPLLAKLLVGYSVDIQKLFGEQYKGQSPKNVSFSGAGFEDEKQAELQQLLTDPEFSLLQTAFSFYSQVQLDSLLQGYSSFSAAKIGLFDQHKVDLKQLKAIFRANFPADVYTAFFSTSKDNYCNYVAYSGRCVQNGKKQPVVYRCLKDKFYEELKKQLAKLPQTARDSSELSAIMLKIENETYLPKPVSKDNSLVPNQIQLSELHQILKNASVYLPFLTRQGEEGLTISEMIEKIASFRIPYYVGPLNPAHRIIPGKPDGSRHAWLTKTHPEPIRPWNFERVVDQEQSATDFINNLTNKCTYLIGEDVLSKDSPTYAKFTLLNMLNVLSINGERLPVLVKQQIYQDLFLHPKNTSRVTKKALLNYLNTEGYPVTESELVGMDLDIPITLKAERQLEALAPGKLTLEDKEEIVRLITIFPESGSMLQNRLSRQFGSKLTESELKTIGKLKFSNWGQFSWKFLTGLVARGPEGKETTIIEAMWNYNLNLMELLSQEYGFSAAIEEYKQTMLGEQTGLSYALVDQYPTSPAVKKMIWQALKVVDEIVKIRKEPPEKVFIEVAREEGEKKRTTSRLDQVKQIFKANKDIEEHLKQELDTQTEETLRRKKLYLYFTQLGRCMYTGKAIDLEKLDAKDAANNEFYDIDHIYPRSLTKDDSLLNNLVLVESSANREKGDKFPISTGIQTARRSWWAVLKDKNLISEEKFRRLVRTTELTPEELESFISRQLVQTRQATKAAAEILKSALPESRIVFVKAGHVSDFRYQQNGFQFPKVRGMNDLHHAKDAYLNIVVGNVFDTKFTQNVRIFLKDHPKGGYNLARMYDFNVIGRSGEIAWQAGESGTIQTVKTIMASNIIQCTWQTHHQTSGQNGGLFDQNLMPKGKGQFPIKTSDPRLAGEDGINKYGGYNKPTGTTFFVVEHTKSRKRQRSILPLNLSWVLTHEQNPQELEAYCKEDLALVEPRVILTDLPYNAILEINGFPMRLLAKTGSSLKVATALQPYFPVEFEPLLKALARQPEEDKEAEAKPRGAFTPEDFLALYDHFTNKLGNEPYSRFSAFTNQHRNLSGSRENFIRLTPFEQTKVLGQILTLFLCDGRTSDLSLLQPKNPDGSPSTKNKQSGMLLISQNLQQGVQVIVRNYSCTGLFLSKTPLSLP

SEQ ID NO: 8626 - protein, 1363 aa, unidentified
  REGION 1..1363: note = Description of Unknown:uncultivated organism sequence
MSIMKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYLVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8627 - protein, 1341 aa, unidentified
  REGION 1..1341: note = Description of Unknown:uncultivated organism sequence
MIKNSEYFIGLDVGTNSVGWAVTDENYNILKVKGKNAIGTHLFEEGKTAETRRVFRTAQRRKDRKRNRILLLNELFDSEICQIDVNFFPRLADSYFWAEDKKINQKNTIFNDAQYKDKDYHKEYPTVYHLRYELMTNKEKKFDIRLIYLAIAHILKNRGHFLFAGQDFNIENSFAELFKTFVSQMHSQLEIEIAENLADNIAKILREAITNTDKNKKLTSLLGKTNKQQAEIIKLLLGNKAILATIFNDDNFNETELKEIQFSKADYLDNEPKYAALLGEKMELITAVKAIYDWSVLSNILKGNTSISQAKIASYDQHKADLKILKQLLKQSLDKDNFSSFFANTTSEKNYCAYIGNSIAKNNSSVCSKEDFYKEIQNLLKPLADSESKTYILNQIALDEFLPKQKTADNGVIPYQLHLKELVQILENAAKHYDFLNSKEAELTISDKIIAIMKFRIPYYVGPLNNYHKIHSWIVKKSAEKVYPWNFEKVVDLANSGEEFIKRMTNRCTYLIGADVLPINSLLYSKFTVLNIINKLKVNDVQIDVDTKQKIYNKLCFTKANITIKDIKNFLLSECQINKNDTLSGIDADLKLSLKPYLDFFRILTEQLFDEEKIEASIKTIVLFGGEKKIIKQRIQAIWGNLISPEQLSAICRLNYSGWGRLSKEFLTEVYHVDPVSNNKFNIIEALYATNNNLMQLLSPQLSYIKNIEERNLEINGVITKFSYETLVKPLYCSPAVKRGIWRTLNIVRELEKVLGKPPKKVFIETTRANDVKGDLGRKSSRQKQLLAIYTKNSLDKDLLTSLKGYAERDLRIKKIYLYYTQLGRCMYSGKIINLADLLNKNLYDIDHIYPRSKTKDDSMDNLVLVDKNLNRSKTDVYPIETNLISAEALALWQRLGKIGLISNEKYKRLTRKEPFSNAELAGFINRQLVETSQSSKAVAEVLKQIFSEDQTEIVYVKSGNVSDFRKNTINRLKVREINDYHHAFDAYLNIVVGNVYNVKFTKNPLNFIDNAEYRSYSLKRIFDFDVKRGKQIAWLRGKEGTIQTVNKMLDTTRLQYTRYPRTVTGEFYKQMPLKKGSGEIPLKSADPRYQDKERYGGYTSDSGAYFILVKHLLKGKEARTIEYVPVRYAKKFELDKTLLLKYCLDKAPYGLELKSPKILIDKIKIDTLFNIDGFPMHISGRTGNYITFKPAVQLILDKESEQYLKKVTSFVERLKTDKDLKINAQYDKITAAENLKLYDLLLEKNNNKIYALRPASQIKVLQEGREKFNLLSLEQQCQLILQILLLTKCAFVRADLKLLGGAGQAGTVKKNKNISDYQKAKIINESPTGFYSQEIDLLKL

SEQ ID NO: 8628 - protein, 990 aa, unidentified
  REGION 1..990: note = Description of Unknown:uncultivated organism sequence
MYTRGFCRGNKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHICKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSEKNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKTIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8629 - protein, 1368 aa, unidentified
  REGION 1..1368: note = Description of Unknown:uncultivated organism sequence
MKYYIGLDMGTNSVGYAVADEEYKLLKAHQKPMIGVRLFDEAQTAAKRRLARVNRRRMERRRQRLALLEDLFSPVISKVDPGFFQRLKESFFMVAHKTEEQPNTLFNDPDFTDRNYHKKYPTIYHLRHELMTSQQPHDVRLVFLAIHHILKHRGHFLNPGELGELGGQLQSCYSQFLVSLSEDFAIELPPDIADQIQAVLTDKTTRRSEKQELLKQLFAVDDDMVAQLSKLFAGLSANISKLFGEQYKEQSPKDVSFSGAGFEDEKQIELQQILTDSEFSLLQSAFNLYAQIQLDSLLQGYPSFSASKIGLYEKHKSDLKRLKKLLKTNLESKAYTAYFSESKKDFCNYVAYSGHCLKNKKKQPVAYRCQKTAFYEELKKILAKLPESIRDGEEVKSIQLEIENETFLPKQVSKDNSLIPNQLQLSELRQILKNAATYLPFLNRQGEDGLTISEMIEKIADFRIPYYVGPVNPAHRVIPGKPNGSRHAWVTKISAEPVRPWNFERVIDLEQSATDFINNLTNKCTYLIGEDVLSKDSPTYARFMLLNILNLLSVNGQRLPVLVKQNIYNDLFLHPKTSGKVTKKKICAYLNAEGYPVTEAELGGMDLEIPISLKAERQLEALAPGKLSLEDKEEIVRLITVFPESNRMLRNRFSRQFGNKLTQSELTAISKLKFAKWGQLSRKFLTGLRANGPDGRETTILEAMWDYNLNLMELLSQDYGFADAVKQYKQDMLGDQQNFSYSLVDQYPTSPAVKKMIWQTMKIVDEIIRIRKQAPEKIFIEVAREEGEKKRTTSRLDQIKQIFKANKDIEDRLKKELDTKSEENLRRKKLYLYFTQLGRCIYTGKAIDLEKLDAKDSANNDFYDIDHIYPRSQTKDDSLMNNLVLVESSANRQKGDDFPIVPGIQAAQKGWWTALKDKKLISEEKYRRLVRTTPLSPEELESFISRQLVQTRQATKAVAELLKLVFPESRVVFVKAGHVSDFRYEQNAFRFPKVRGMNDLHHAKDAYLNIVVGNVFDTKFTQDVRNYIKNHPKRDFNLGRMYDFDVVGASGKLAWKTGEEGSIRMVRSMMALNAIQCTWQTSGQNGGLFDQNLLPKGKGQFPIKTSNPHLAGQEGINNYGGYNKPTGATFFVVEHELRKKAQRTILPLDLTWVLTHEQTAPELEAYCRETLGLIEPRVILADLPYNSILEVNGFPLRLLAKTGASLKLAPALQPYFPTAYEPILKALTRQAEEGKDAEADPRAVYPPEENLALYDHFTQKLGSEPYSRLSVFVNQYRNLSASRGNFILLTPFEQMKVLGQILILFLCDGRTSDLSLLQPKNPNGTPSSKNKQSGMVTISQNLQKGIKVDVLNFSCTGLFLSRTPLSQP

SEQ ID NO: 8630 - protein, 1363 aa, unidentified
  REGION 1..1363: note = Description of Unknown:uncultivated organism sequence
MSIMKEINEYYLGLDMGEGSLGWAVTTPDYHVVKKAGKALWGVRLFESAKTAKERRVFRTGRRRIERRNRRIDFLQELFSEAVCEKDPGFYQRLNDSRLWEEDKTERQINSLFNDVDFTDKSYHKKFPTIYHLRQKLMEDSCEFDVRLVYLAIHHILKHRGHFLLENFEIREDGAVGFEEAMADLGNVLGQFLDRSLPVENNDACKEILKNRKLNKLEKLEQLGKLYDAGGDKSIKEIFRLIVGGTAHLAVIFCDETLKNTERGKISFEDAQYEEYKNDVQTILDDRFDVVAACETLHNWAILAELMGNYKYISDAKVAIFNEHRKDLTVLKRLLKRDSNVYTKMFRMAGKNSYSAYVGLCKIHGKKVPIEKACTQGDFAGEIKKIIKNFPDSEDKKYILDKIERNELLPKAVSKQNGVIPYQLHLVELNKILSNAERYLPFLKKEDEYGTVSDKIRKLFTFRIPYYVGPLNGHSPFAWAVRKDENGHIYPWNFERKIDIEASAEEFIRRMTNKCTYFVKKDVLPKNSLLYTEFMVLNELNNVRIGSAQEKLPPGMKARVWERLFLKDKKITAKKMCSYLIREEHISKEEAAQISGIERDFKASLAPWIDMRKILGDNFTVSDSEKIIKDITLFGADKKMLRRRLKARFGYLEDCQVKELVRLPYQGWGRLSKEFLTQILPKAERDSTVLVDQETGEVMNIITALKKTDHNLMELLSGKFGYSAALSEVNTTSVSVCDKAISYKNIQDMRISPAVKRPLWQTLRVIKEIIHIMGKAPSRIFIEMARAEDEKKWKTVSRKDRLLDLYKKCKDEIRNWSADIKKLGEEIKELSDGQLRSDKLYLYYTQMGRSMYTGKPICLGSLMAGADYDIDHIYPRSATGDDSLDNRVLVERTENAKKGDHYPLSIEIQGGRAVFWKVLLDKGFISKEKYRRLTRKTLLTDDEKAGFIGRQLVETRQSTKAIAEILKKAFPETKIIYTKARNVSRFRQYAEFVKVRDMNDYHHAKDAYLNIVVGNAFYTKFTSNPIHFLSERNAVYSLNERTFYQFPIQRGSTMAWEPGDSGTMAVVRKWMDKNNILYTRMPFEEKGGLFDQNILKKGKGQVSLRARGALSDIQKYGGYNNATASYFMLVKAEKNGKIIYLLETVPLHLSGRLESIEDKINFCRELWHRDRKDYKNPVICIPKIYKQSLFEVDGFREHISAKTGNQFVMRNAEQLCLNAESAQIIKNVLKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 8631 - protein, 1368 aa, unidentified
  REGION 1..1368: note = Description of Unknown:uncultivated organism sequence
MKYYIGLDMGTNSVGYAVADEEYKLLKAHQKPMIGVRLFDEAQTAAKRRLARVNRRRMERRRQRLALLEDLFSPVISKVDPGFFQRLKESFFMVAHKTEEQPNTLFNDPDFTDRNYHKKYPTIYHLRHELMTSQQPHDVRLVFLAIHHILKHRGHFLNPGELGELGGQLQSCYSQFLVSLSEDFAIELPPDIADQIQAVLTDKTTRRSEKQELLKQLFAVDDDMVAQLSRLFAGLSANISKLFGEQYKEQSPKDVSFSGAGFEDEKQIELQQILTDSEFSLLQSAFNLYAQIQLDSLLQGYPSFSASKIGLYEKHKSDLKRLKKLLKTNLESKAYTAYFSESKKDFCNYVAYSGHCLKNKKKQPVAYRCQKTAFYEELKKILAKLPESIRDGEEVKSIQLEIENETFLPKQVSKDNSLIPNQLQLSELRQILKNAATYLPFLNRQGEDGLTISEMIEKIADFRIPYYVGPVNPAHRVIPGKPNGSRHAWVTKISAEPVRPWNFERVIDLEQSATDFINNLTNKCTYLIGEDVLSKDSPTYARFMLLNILNLLSVNGQRLPVLVKQNIYNDLFLHPKTSGKVTKKKICAYLNAEGYPVTEAELGGMDLEIPISLKAERQLEALAPGKLSLEDKEEIVRLITVFPESNRMLRNRFSRQFGNKLTQSELTAISKLKFAKWGQLSRKFLTGLRANGPDGRETTILEAMWDYNLNLMELLSQDYGFADAVKQYKQDMLGDQQNFSYSLVDQYPTSPAVKKMIWQTMKIVDEIIRIRKQAPEKIFIEVAREEGEKKRTTSRLDQIKQIFKANKDIEDRLKKELDTKSEENLRRKKLYLYFTQLGRCIYTGKAIDLEKLDAKDSANNDFYDIDHIYPRSQTKDDSLMNNLVLVESSANRQKGDDFPIVPGIQAAQKGWWTALKDKKLISEEKYRRLVRTTPLSPEELESFISRQLVQTRQATKAVAELLKLVFPESRVVFVKAGHVSDFRYEQNAFRFPKVRGMNDLHHAKDAYLNIVVGNVFDTKFTQDVRNYIKNHPKRDFNLGRMYDFDVVGASGKLAWKTGEEGSIRMVRSMMALNAIQCTWQTSGQNGGLFDQNLLPKGKGQFPIKTSNPHLAGQEGINNYGGYNKPTGATFFVVEHELRKKAQRTILPLDLTWVLTHEQTAPELEAYCRETLGLIEPRVILADLPYNSILEVNGFPLRLLAKTGASLKLAPALQPYFPTAYEPILKALTRQAEEGKDAEADPRAVYPPEENLALYDHFTQKLGSEPYSRLSVFVNQYRNLSASRGNFILLTPFEQMKVLGQILILFLCDGRTSDLSLLQPKNPNGTPSSKNKQSGMVTISQNLQKGIKVDVLNFSCTGLFLSRTPLSQP

SEQ ID NO: 8632 - protein, 1372 aa, unidentified
  REGION 1..1372: note = Description of Unknown:uncultivated organism sequence
MKYYIGLDMGTNSVGYAVADEEYKLLKAHQKPMIGVRLFDEAQTAAKRRLARVNRRRMERRRQRLALLEDLFSPVISKVDPGFFQRLKESFFMVAHKTEEQPNTLFNDPDFTDRNYHKKYPTIYHLRHELMTSQQPHDVRLVFLAIHHILKHRGHFLNPGELGELGGQLQSCYSQFLVSLSEDFAIELPPDIADQIQAVLTDKTTRRSEKQELLKQLFAVDDDMVAQLSRLFAGLSANISKLFGEQYKEQSPKDVSFSGAGFENEKQIELQQILTDSEFSLLQSAFNLYAQIQLDSLLQGYPSFSASKIGLYEKHKSDLKRLKKLLKTNLESKAYTAYFSESKKDFCNYVAYSGHCLKNKKKQPVAYRCQKTAFYEELKKILAKLPESIRDGEEVKSIQLEIENETFLPKQVSKDNSLIPNQLQLSELRQILKNAATYLPFLNRQGEDGLTISEMIEKIADFRIPYYVGPVNPAHRVIPGKPNGSRHAWVTKISAEPVRPWNFERVIDLEQSATDFINNLTNKCTYLIGEDVLSKDSPTYARFMLLNILNLLSVNGQRLPVLVKQNIYNDLFLHPKTSGKVTKKKICAYLNAEGYPVTEAELGGMDLEIPISLKAERQLEALAPGKLSLEDKEEIVRLITVFPESNRMLRNRFSRQFGNKLTQSELTAISKLKFAKWGQLSRKFLTGLRANGPDGRETTILEAMWDYNLNLMELLSQDYGFADAVKQYKQDMLGDQQNFSYSLVDQYPTSPAVKKMIWQTMKIVDEIIRIRKQAPEKIFIEVAREEGEKKRTTSRLDQIKQIFKANKDIEDRLKKELDTKSEENLRRKKLYLYFTQLGRCIYTGKAIDLEKLDAKDSANNDFYDIDHIYPRSQTKDDSLMNNLVLVESSANRQKGDDFPIVPGIQAAQKGWWTALKDKKLISEEKYRRLVRTTPLSPEELESFISRQLVQTRQATKAVAELLKLVFPESRVVFVKAGHVSDFRYEQNAFRFPKVRGMNDLHHAKDAYLNIVVGNVFDTKFTQDVRNYIKNHPKRDFNLGRMYDFDVVGASGKLAWKTGEEGSIRMVRSMMALNAIQCTWQTRHQTSGQNGGLFDQNLLPKGKGQFPIKTSNPHLAGQEGINNYGGYNKPTGATFFVVEHELRKKAQRTILPLDLTWVLTHEQTAPELEAYCRETLGLIEPRVILADLPYNSILEVNGFPLRLLAKTGASLKLAPALQPYFPTAYEPILKALTRQAEEGKDAEADPRAVYPPEENLALYDHFTQKLGSEPYSRLSVFVNQYRNLSASRGNFILLTPFEQMKVLGQILILFLCDGRTSDLSLLQPKNPNGTPSSKNKQSGMVTISQNLQKGIKVDVLNFSCTGLFLSRTPLSQP

SEQ ID NO: 8633 - protein, 1372 aa, unidentified
  REGION 1..1372: note = Description of Unknown:uncultivated organism sequence
MKYYIGLDMGTNSVGYAVADEEYKLLKAHQKPMIGVRLFDEAQTAAKRRLARVNRRRMERRRQRLALLEDLFSPVISKVDPGFFQRLKESFFMVAHKTEEQPNTLFNDPDFTDRNYHKKYPTIYHLRHELMTSQQPHDVRLVFLAIHHILKHRGHFLNPGELGELGGQLQSCYSQFLVSLSEDFAIELPPDIADQIQAVLTDKTTRRSEKQELLKQLFAVDDDMVAQLSKLFAGLSANISKLFGEQYKEQSPKDVSFSGAGFEDEKQIELQQILTDSEFSLLQSAFNLYAQIQLDSLLQGYPSFSASKIGLYEKHKSDLKRLKKLLKTNLESKAYTAYFSESKKDFCNYVAYSGHCLKNKKKQPVAYRCQKTAFYEELKKILAKLPESIRDGEEVKSIQLEIENETFLPKQVSKDNSLIPNQLQLSELRQILKNAATYLPFLNRQGEDGLTISEMIEKIADFRIPYYVGPVNPAHRVIPGKPNGSRHAWVTKISAEPVRPWNFERVIDLEQSATDFINNLTNKCTYLIGEDVLSKDSPTYARFMLLNILNLLSVNGQRLPVLVKQNIYNDLFLHPKTSGKVTKKKICAYLNAEGYPVTEAELGGMDLEIPISLKAERQLEALAPGKLSLEDKEEIVRLITVFPESNRMLRNRFSRQFGNKLTQSELTAISKLKFAKWGQLSRKFLTGLRANGPDGRETTILEAMWDYNLNLMELLSQDYGFADAVKQYKQDMLGDQQNFSYSLVDQYPTSPAVKKMIWQTMKIVDEIIRIRKQAPEKIFIEVAREEGEKKRTTSRLDQIKQIFKANKDIEDRLKKELDTKSEENLRRKKLYLYFTQLGRCIYTGKAIDLEKLDAKDSANNDFYDIDHIYPRSQTKDDSLMNNLVLVESSANRQKGDDFPIVPGIQAAQKGWWTALKDKKLISEEKYRRLVRTTPLSPEELESFISRQLVQTRQATKAVAELLKLVFPESRVVFVKAGHVSDFRYEQNAFRFPKVRGMNDLHHAKDAYLNIVVGNVFDTKFTQDVRNYIKNHPKRDFNLGRMYDFDVVGASGKLAWKTGEEGSIRMVRSMMALNAIQCTWQTRHQTSGQNGGLFDQNLLPKGKGQFPIKTSNPHLAGQEGINNYGGYNKPTGATFFVVEHELRKKAQRTILPLDLTWVLTHEQTAPELEAYCRETLGLIEPRVILADLPYNSILEVNGFPLRLLAKTGASLKLAPALQPYFPTAYEPILKALTRQAEEGKDAEADPRAVYPPEENLALYDHFTQKLGSEPYSRLSVFVNQYRNLSASRGNFILLTPFEQMKVLGQILILFLCDGRTSDLSLLQPKNPNGTPSSKNKQSGMVTISQNLQKGIKVDVLNFSCTGLFLSRTPLSQP

SEQ ID NO: 8634 - protein, 1399 aa, unidentified
  REGION 1..1399: note = Description of Unknown:uncultivated organism sequence
MEITGHGTKGASDYYIGLDIGTASVGWAVTDPSYELVKKHRKNLWGVRLFDTANTAEERRLHRSARRRHQRKLQRLRILREIFDRSIAEVDPQFFTRLRESLYHADDRSGSFISTLFDDDSFKDSDYHKKFPTIFHLRSHLLHHPDEKPDIRMLYLAIHSILKNRGHFLIPGETLDTTSSLYALVDNLQRETSAALGCTLEFSCPPEDLGMILKMRRKSERKSKLTEISTLTRITGDQVEENPKRQATELIKALAGTPFMLSALFSEEAYQDHENNKIEFDTEGYEESKDAIEVLLEPEEFALIEAIEGLRSWALLSDILHGEAYISDAKTISYAEHKEDLKKLKRLVKAYVAESFIAAFKDPAESNNYAHYVGTGNKSGVKVQVIHKSKCSQDDVNKYFEGLLKPFKNNEDDLLVEMLGKLEVRSALPKQRVRDNRVIPHQLHKKELEVILAHAKRYYPFLSVPDADGYSAIDKIMGMMTFRIPYYVGPLNTAHLRDEGKEGFCWMVRQQGKEQAPILPWNWEDVVDKNASAEKFISRMTNACTYLFDQKVLPKYSLLYNRFMVLNELNNLKVNGEPVTVELKQRLYTELFLESGKKKITEKMLKKFLLTNNIINRGDEVLIEGIDQGFTNSLKSHIDFSHYLNEKILTVEEVEQIIEWKAFYVDDTSILREKITEELGRKLSEEQISDIVQIIRSYKGWGRLSRVFLEEVYHEIPATGEVRSIIQMMWETNNNLMKLLSSEFDFLDETQRINNEKLLQTSFSYDTLVKPLAVSPPVKRQIWQTLLIVRELRKVMGKAPRRVFVEMARERGEKVRTTSRKQTLVKLYENCKNDIGFNKALLETLEEKTDAELRNDRLYFYYTQMGRCPYCGGRIEIEQMHNPQLYDIDHIYPQSLIKDDSLNNRVLSHKTCNGNKGGDYPINPIWQEKMHGFWKMLLTRELISAEKFKRLTRTTSLSDDELFAFINRQLVETRQSTKVVSTILKNLFQDDDTEIIYVKARNVSNFRTDFEIKKSRLVNDHHHAHDAYLNIVVGNTYHTRFTDDPRVFIKELRRTNQNYNASNLFTKNVERNGKIAWIADEEYWRNRGRKKREKRETGTILTIRETLRNHQVLITRQSVEASGALFKLQPLRKKQNLIPLKGSDPKLYETTKYGGYNAASTAYFALVEHIVKKKPVRSLVPIPIQYAQQFKLDSTKLVGHCTEHLHYDSPNLVLERILLHEMVCVQNFFMSLSGITGSRVVANNEVQLVLSEQYYDYFSQVEKYLSLLKKVKASEVLENAEILAEDLEITREANLALYDLLLAKERDSIYRNRPANQAKLLTTKQSLFTTLDIKTQCEVLVQILNLFTCTPESADLKVIGGGGRTGIVLFQSQIKDTNAQLIHRSPTGIFSKSVRVYDL

SEQ ID NO: 8635 - protein, 1063 aa, unidentified
  REGION 1..1063: note = Description of Unknown:uncultivated organism sequence
MELKLGLDIGVASVGWGIIDENYNVINSGVRLFSEGSAEENLTRRTMRSSRRRIRRRHHRLQRMGILLSNILAIDLPEPQGNIYEIRCRGLQEMLSREELFLAVMHLTKRRGTHFLTAEDIEEKNNNGKSTEEILAEQEDCLAKKYVCEIQYERYLTDNGRVRGIENRFRNKDYLREFEQLLAAQSEFYDEIEKNAAAILELYKSKREYYEGPGSEKSPTPYGRYRYNENGNVIKIDLIDLMRGRCTYFPEEKRIAKGAYTACLFNLLNDLNNLKVGERKLTEDEKEYFVKEFIDKGKNITLKIIAKKVVKDENEITGYRIDKKNKPLFTEFKQYKSILKIYQAFDKVDYAEGNLDLCDNISEILTRLKSVEERKIALMNYGIEKEIAQELSKASGFTEYHSLSKKAMDLVMGDLWATDKNQMQLFYDAGMTEVNKNDYIGEEIKFDGSDWIVSPITKRAVAESVKVINAARKLVRRKYGQEFSDIVIEMAREKNSAEEKQNKQKIQRINEERGNAIRELTLGKKITPRQFEIIGLLKEQDMKCAYSGKPVSLTQVYENMLEVDHIIPRSLSFDNSRNNKVAVFVSENQKKGQRTPFQYLNSGAGSITYADFKVMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKAIIFDNGMVVNTVTGEFVSEADFAANKYIQFIKQIELRPQKYSHKVDRKPNRQLYNQQIKSTRTCLDSKGKEEIYVVTKYKNIYTVGMGSCGDKLKKRILENPESLLMYRNDQETFKKFREIVDFYNDAKNPFAEYFKEHGTIKKYAKKDNGPEIFDVKFLDGRLGVHRINSRQQGKNKSVYLQIKSLRVDIYQEGERYKFVNVPYDMLKFSYGVYKIDMEKYLKSKLNKKITEQGIFLFSLYRGEVFSYEKDGVKYWWQFSCLNSDYSNVIEVKYIDKPSLSDNTRNDRKITIGSKIKNMKKHHVDVLGNIYPAGKEILQTEIKL

SEQ ID NO: 8636 - protein, 1065 aa, unidentified
  REGION 1..1065: note = Description of Unknown:uncultivated organism sequence
MELKLGLDIGVASVGWGIIDENYNIIDSGVRLFSEGTAEENLKRRTARSARRRERRTRHRLDRMGVLLSNLLEIDLPEPFGNIYEIRCRGLKEKLAPEELFLALMHLTKRRGTFYLTAEDIENKETDGKSAEDILLEQEAKLKEKFVCELQYEKFLTNNGTVRGTENRFRNKEYLREVEKLIDVQGNFYKNVAEHKDEILSIYKSKREYFEGPGSEKSPTPYGCYRYDENGNVIKVNLIDLMRGKCTYFPDEQRIAKGAYTANLFNILNDLNNLKFSDRKITEEEKKTLINEYINKGKNITLANIAKICNVTQDEISGYRIDKSNKPVFTEFKQYKDLLKTFNKFNKKEIIEGNISLCDNIADILTKEKSVEVRESELLNIGIDLDVAAEIAKLSGFTQYHSLSKKAMNLIMPDLWATDKNQMQLFYEAGLLENKNQANIGKNIKFDGEDWIVSPVTKRAVSEAVKVINACRKLVKDNYGVEFSDIIIEMAREKNLDEQKKLKKDIQKRNEERANEIHKLTLNKKITPRQFEIINLLMDQDMKSAYSGKPVSLQQVYEGMLEVDHIIPRSISFDDSKNNKVAVFINENRNKAQRTPFMYLKSGEGEITYEEFKNMVLKNNRYTKNKKANLLFENGLPEKEMTGFINRNLVDTRYACRKVLNMLQDYFKANNINTKVKTVKGSATFTFRKKAKLDKDREATYAHHAQDALIIAGLFNTELMRKLNSIVDLSDEFLTNKETLVFENGRIIDSATGEFIDDEDFNAGKYIKFIKEVELRKQKYSHKVDRKPNRQLYDLQIKSTRVCTDEKGNERIYIITKYKNIYNEGIGSTGDKLAERIRKNPETILMYHNDPQTFKKFQEVVEAYPNEKNPFARYKEDYGQYITKYAKHNNGPAITDVKFMDGQLGSHRVNQKQAGKNKSVYLQIKTLRADFYLDNGKYKFISVPYDMIRVEKGVYKIDLGKYQSEKIKKKISDDATFVFSLYKGEFFSYEKDNEKFMWQYSCVNNDSKNVIETKYVDKPSPGNTQRYRMITIGNKITNMQKYNVDVLGNIYPVFKEHLKLEMDFR

SEQ ID NO: 8637 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITNRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFPSGVYKIDMEKYLQSKQNKKITKQAIFLFSLYHGEVFSYEKEGVKYWWQFSCLNNDTSNVIEVKYMVKPSPAATQGKRMITIGSKIKNMKKYHVDVLGNIYPASKEILQTEIKL

SEQ ID NO: 8638 - protein, 1062 aa, unidentified
  REGION 1..1062: note = Description of Unknown:uncultivated organism sequence
MELKLGLDIGVASVGWEIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFPSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8639 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8640 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKIDMEKYLQSKQNKKITKQAIFLFSLYHGEVFSYEKEGVKFWWQFSCLNNDTSNVIEVKYIDKPSPAATQGKRMITIGSKIKNMKKYHVDVLGNIYPASKEILQTEIKL

SEQ ID NO: 8641 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFPSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8642 - protein, 863 aa, unidentified
  REGION 1..863: note = Description of Unknown:uncultivated organism sequence
MNVYSSKREYYEGPGSAKSPTPYGCYRYDVNGNVIKVDLIELMRGKCTYFPDEKRIAKGAYTACLFNLLNDFNNLKIGERKLSEEEKQYFVQEFIDKGKNITVRVIAKKVNKAESEITGYRIDKKNKPLFTEFKQYISILKIYKDFSKENSVMGNIKLCDDIAEILTQKKSLEDREHELIVAGIEQDIAQKLAKLSGFTQYHSLSKKAMDLIMSDLWKTEKNQMQLFHDVGLTENNQTAYIGEDIKFDGDDWIVSPITKRAVAESVKVINAARKLIKRKYGEEFSDIVIEMAREKNTSEEKQRKLETQKLNEERGKAIRELTLGKKISSKQFEIIGLLQEQDMKCAYSGKPVSLLQVYENMLEVDHIIPRSLSFDNSRSNKVAVFISENQKKGQHTPFQYLNSGMETITYEEFKKIVVANRNYSNRKKANLLYENAPEKELRGFINRNLVDTRYACREVLNMLQNYFKANEINTKIKVVNGAFTFEFRKKAKLAKDRDATYAHHAQDALIIAGLFNTELLKKLNSVVKMSDSFLDEKETIIFENGKVINIATGEFISEDDFSANKYIQFIKQVEMRPQKFSHKVDRKPNRQLYDQQIKSTRICCDDEGKEETYVVTKYKNIYTVGLGSCGDKLKKRILEKPETLLMYRNDPETFKKFKEIVEFYNDAKNPFAEYYSEHGSIRKYSKKNNGPEIFDVKFLEGRLGIHRVNSKQNGKNKSVYLQIKSLRIDVYQNGEQYKFINVPYDMLKFVNGVYQIEMDKYLQAKDNKKITDVAEFKFSLYRGEFFSYEKDGKKYSWQFSCLNNDTNNVIEAKYIDQPSPGATQGKRMITIGSKIKNLRKYHVDILGNIYPATKEVLKTEIEL

SEQ ID NO: 8643 - protein, 1062 aa, unidentified
  REGION 1..1062: note = Description of Unknown:uncultivated organism sequence
MKLKLGLDIGVASVGWGIIDEDYNIIDSGARLFSEGSAEENLTRRTMRSSRRRIRRMHHRLTRMGQLLANMLDIDLPDPQGNIYEIRSRGLQEKLSKEELFLAIMHLTKRRGTHFLTAEDIEEKNSYGKSNEEILLEKEQKLSEKYVCEIQYENYLNNAGKVRGIENRFRNKEYLKELTKLLEVQGIFYFAVADNIDAILNVYSSKREYYEGPGSAKSPTPYGCYRYDVNGNVIKVDLIELMRGKCTYFPDEKRIAKGAYTACLFNLLNDFNNLKIGERKLSEEEKQYFVQEFIDKGKNITVRVIAKKVNKAESEITGYRIDKKNKPLFTEFKQYISILKIYKDFSKENSVMGNIKLCDDIAEILTQKKSLEDREHELIVAGIEQDIAQKLAKLSGFTQYHSLSKKAMDLIMSDLWKTEKNQMQLFHDVGLTENNQTAYIGEDIKFDGDDWIVSPITKRAVAESVKVINAARKLIKRKYGEEFSDIVIEMAREKNTSEEKQRKLETQKLNEERGKAIRELTLGKKISSKQFEIIGLLQEQDMKCAYSGKPVSLLQVYENMLEVDHIIPRSLSFDNSRSNKVAVFISENQKKGQHTPFQYLNSGMETITYEEFKKIVVANRNYSNRKKANLLYENAPEKELRGFINRNLVDTRYACREVLNMLQNYFKANEINTKIKVVNGAFTFEFRKKAKLAKDRDATYAHHAQDALIIAGLFNTELLKKLNSVVKMSDSFLDEKETIIFENGKVINIATGEFISEDDFSANKYIQFIKQVEMRPQKFSHKVDRKPNRQLYDQQIKSTRICCDDEGKEETYVVTKYKNIYTVGLGSCGDKLKKRILEKPETLLMYRNDPETFKKFKEIVEFYNDAKNPFAEYYSEHGSIRKYSKKNNGPEIFDVKFLEGRLGIHRVNSKQNGKNKSVYLQIKSLRIDVYQNGEQYKFINVPYDMLKFVNGVYQIEMDKYLQAKDNKKITDVAEFKFSLYRGEFFSYEKDGKKYSWQFSCLNNDTNNVIEAKYIDQPSPGATQGKRMITIGSKIKNLRKYHVDILGNIYPATKEVLKTEIEL

SEQ ID NO: 8644 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILSEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVIENQKKGQRTPFQYLNSGAGAITYADYKAMVLKNNSYSARKKANLLYEEAPEKELHGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKVDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8645 - protein, 1064 aa, unidentified
  REGION 1..1064: note = Description of Unknown:uncultivated organism sequence
MNFKLGLDLGVASVGWGIIDENYNIIDSGVRLFSEASAKENVKRREMRSSRRRVRRVRHRLDRMGILLSEILEIDLPEPFGNIYEIRCRGLKEKLKKEELFLALMHLTKRRGTFYLTADDIENKEDNGKSTEEILLEQEIKLKENYICEIQYKEFLENGKVRGTENRFKNKEYLREVEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRKSELEKRGIEKNIASEIAKLSGFTQYHSLSKKAINMIINDLWASDKNQMQLFHDCGLTEYKNRANLGEKIKFDGSEWIVSPITKRTVTEAVKVINACRKMLKQKYNTEFSDVVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRAIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIAM

SEQ ID NO: 8646 - protein, 1064 aa, unidentified
  REGION 1..1064: note = Description of Unknown:uncultivated organism sequence
MNFKLGLDLGVASVGWGIIDENYNIIDSGVRLFSEASAKENAKRREMRSSRRRVRRVRHRLDRMGLLLSEILEIDLPEPFGNIYEIRCRGLKEKLKKEELFLALMHLTKRRGTFYLTADDIENKEDNGKSAEEILLEQEIKLKGNYICEIQYKEFLENGKVRGTENRFKNKEYLREVEALLNIQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFSDRKLVEGNALLCDDIAEVLTKEKSVDIRKSELEKRGIEKNIASEIAKLSGFTQYHSLSKKAINTIIGDLWSTGKNQMQLFHDCGLTEYKNRANLGEKIKFDGSEWIVSPITKRTVTEAVKVINACRKMLKQKYNTEFSDIVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRTIIDEKGKEKTYVITKYKNIYVEGIGSTGDKLAERIRKNPESLLMYHNDPATFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDLEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 8647 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVTESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFPSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8648 - protein, 1064 aa, unidentified
  REGION 1..1064: note = Description of Unknown:uncultivated organism sequence
MNFKLGLDLGVASVGWGIIDENYNIIDSGVRLFSEASAKENVKRREMRSSRRRVRRVRHRLDRMGILLSEILEIDLPEPFGNIYEIRCRGLKEKLKKEELFLALMHLTKRRGTFYLTADDIENKEDNGKSTEEILLEQEIKLKENYICEIQYKEFLEKGRVRGTENRFKNKEYLHELEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRKSELEKRGIEKNIASEIAKLSGFTQYHSLSKKAINTIIGDLWSTGKNQMQLFHDCGLTEYKNRANLGEKIKFDGSEWIVSPITKRTVTEAVKVINACRKMLKQKYNTEFSDIVIEMAREKNLDEKKKMEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRTIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 8649 - protein, 564 aa, unidentified
  REGION 1..564: note = Description of Unknown:uncultivated organism sequence
MEKDIQKKNELRAKAIHELTSNRKLTPRQFEIINLLLDQDMRSAYSGKAVSLPQVYEGMLEVDHIIPRSISFDDSKNNKVAVFISENQKKAQRTPFMYLKSGEGEISYEKFKEMVLKNTRYSKSKKANLLLENGLPEKEMIGFINRNLVDTRYACRKVLNMLQDYFKINNIDTKVKVIKGSATFAFRKKAKLDKNREESYAHHAQDALIIAGLFNTDLMKKLNCIVDLNEEFINDKENLIFENGKVINKNTGEFISDEDFNASKYIQFIKQVELRKQKYSHKVDRKPNRQLYDQQLKSTRAIIDEKGKEKTYVITKYKNIYAVGVGSTGDKLAERIRKNPESLLMYHNDPETFKKLLEVVNAYPDKKINPFAKYKEEYNQYITKYAKHNNGPIIMDVKFIDGQLGVHRVNKKQNGKNKSVYLQIKSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 8650 - protein, 518 aa, unidentified
  REGION 1..518: note = Description of Unknown:uncultivated organism sequence
MNFKLGLDLGVASVGWGIIDENYNIIDSGVRLFSEASAKENVKRREMRSSRRRVRRVRHRLYRMGILLSEILEIDLPEPFGNIYEIRCRGLKEKLKKEELFLALMHLTKRRGTFYLTADDIENKEDNGKSTEEILLEQEIKLKENYICEIQYKEFLEKGRVRGTENRFKNKEYLHELEALLNMQAQFYPVIAEYKDEIYKIYNSKREYFEGPGSEKSPTPYGSYRYDENGNVIKVNLIDLMRGKCTYFPDEKRIAKGAYTAALFNILNDLNNLKIKDRKITEEEKRNLIENYINKGKNITLNYIAKVTGVDVEEISGYRIDKSEKPIFTEFKQYKDILKVFDKFGDRKLVEGNALLCDDIAEVLTKEKSVDIRKSELEKRGIEKNIASEIAKLSGFTQYHSLSKKAINTIIGDLWSTGKNQMQLFHDCGLTEYKNRANLGEKIKFDGSEWIVSPITKRTVTEAVKVINACRKMLKQKYNTEFSDVVIEMAREKNLDEKKKWRKIFKRKMNCVQKLFMN

SEQ ID NO: 8651 - protein, 1064 aa, unidentified
  REGION 1..1064: note = Description of Unknown:uncultivated organism sequence
MGYILGLDIGVASVGYAVIDNQYNIITSGVRLFREGTAAENADRRAFRSSRRGIRRSHHRLERLTALLSTALDSKDDRSYTNIYEIRVKGLSDKLEPSELKAAIIQLAKHRGIFYLSPEDLAVEDGSSQSSADIIRSNEHKLKSDIYPCHIQLEKLKTTGTVRGIDNKFTHESYRKELVKLLDVQSKFYPQLEDIRKGILDIYDSKREYYEGPGSDKSPTPYGSYQLDENGDVIKINLIDKMRGKCTYFPDELRAPKWSYSACLFNLLNDLNNLTINGEKITKTQKKDLIDEYVNKGKSVTLPAISRICGVKKEDILGYRIDSSGKPIFTKFDGYNELLKIAKSVNEESLIVGNKRLIDDISEILTKEKSLEIREEQLSKELGLSASLAKELVKATGFTAYHSLSFKAINLILNDLLQTTNNQMALYTAAGIKPCNRNWSQGNQLSANLAEWIVSPVVKRSLNETIKVFNALRKYIKKEFGEASEFSDVVVELAREKNSQDKKDHIKKILKDNEDKRHQIMELVEGRKLDSADFQRISLLMEQDFKCAYSLEPIELADVFKPGLLEVDHIIPLSISLSDAQSNKVLVYHSENQKKGQQTPFQYFSSGKAKVTFEKFKEYVNQNSNFIKAKRENLLYLGNPVEDLKGFIKRNLVDTRYASSEFYNLLKSFFDYHKLDTKVKVINGGATHYFRKKAHLSKDRNETHAHHAQDALIIAGFANTKLVKFFSKIGAFSDNFEDKNALIEVDGDIVSSETGEVLNVDLFDKKENISAYIQFLKRIEEIQPLFSHKVDRKPNRGLYDQQIKATRKFVEGNKEETYIITKYSDIYNTAAGNSGSKLKKRILESPEDLLMYHHDVKTFEIFKKIVEQYSEEANPFAAYKADYGSIRKYSKKGNGPIIESVKFRDKKLGSHRINMKQESKNASVFLKIKSLRTDIYQDGSNYLVLNVPYDMVQFTNSRYIINQGKYNEARSKQRIPASAKFVTSLYRGDYITYEESGQTVEYIFKCLNNELTHRIEVSYVDRPTDKQLLKAIKNSISNLTKYNVDVLGNKHKVSNEKLKFDVTI

SEQ ID NO: 8652 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSVTFDFCKKTKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFPSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8653 - protein, 572 aa, unidentified
  REGION 1..572: note = Description of Unknown:uncultivated organism sequence
MGYILGLDIGIASVGYAVIDNQYNIITSGVRLFREGTAAENADRRAFRSSRRGIRRSHHRLERLTALLSTALDSKDDRSYTNIYEIRVKGLSDKLEPSELKAAIIQLAKHRGIFYLSPEDLAVEDGSSQSSADIIRSNEHKLKSDIYPCHIQLEKLKTTGAVRGIDNKFTHESYRKELVKLLDVQSKFYPQLEDIKEEILNIYDSKREYYEGPGSYKSPTPYGSYQLDENGDVKKINLIDKMRGKCTYFPDELRAPKWSYSACLFNLLNDLNNLTINGKKITKKQKQDLIDGYVNKGKSVTLPAISRVCGVKKEDILGYRIDSSGKAIFTKFDGYNELLKIAKSVNEESLIVGNTQLIDDISEILTKEKSLEIREEQLSEKMGLSAPLAKELAKATGFTAYHSLSFKAINLILNDLLQTTNNQMALYTAAGIRPYNHNWSQGNQLSANLAEWIVSPVVKRSLNETIKVFNALRKYIKKEFGEASEFSDVVVELAREKNSQDKKDHIKKILKDNEDKRYQIMELVEGRKLDSADFQRISLLMEQDFKCAYSLEPIELADVFKPGLLEVDHIIP

SEQ ID NO: 8654 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKIDMEKYLQSKQNKKITKQAIFLFSLYHGEVFSYEKEGVKYWLQFSCLNNDTSNVIEVKYIDKPSPAATQGKRMITIGSKIKNMKKYHVDVLGNIYPASKEILQTEIKL

SEQ ID NO: 8655 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFPSGVYKIDMEKYLQSKQNKKITKQAIFLFSLYHGEVFSYEKEGVKYWLQFSCLNNDTSNVIEVKYIDKPSPAATQGKRMITIGSKIKNMKKYHVDVLGNIYPASKEILQTEIKL

SEQ ID NO: 8656 - protein, 1064 aa, unidentified
  REGION 1..1064: note = Description of Unknown:uncultivated organism sequence
MGYILGLDIGIASVGYAVIDDQYNIITNGVRLFREGTAAENVDRRAFRSSRRGIRRSHHRLERLTALLSTALDSKDDSSYTNIYEIRVKGLSDRLEPSELKAAIIQLTKHRGIFYLSPEDLAVEDGSSQSSADIIRINEHKLKSDIYPCHIQLEKLKTTGVVRGIDNKFTHESYRKELVKLLDVQSKFYSQLEDIKEEILNIYDSKREYYEGPGSYKSPTPYGSYQLDENGNVIKINLIDKMRGRCTYFPDELRAPKWSYSACLFNLLNDLNNLTINGEKITEKQKQELIDEYVNKGKSVTLPAISRVCGVKKEDILGYRIDSSGKAIFTKFDGYNELLKIAKSVNEESLIVGNNQLIDDISEILTREKSLEIRKEQLSEKLGLFAPLAKELAKATGFTAYHSLSFKAINLILNDLFQTTNNQMALYTAAGIKPYNRNWAQGNQLSANLAEWIVSPVVKRSLNETIKVFNALRKYLKKEFGEASEFSDVVVELAREKNSQNKKEHIKKILKDNENRRYQIMELVEGRKLDSVDFQRISLLLEQDFKCAYSLEPIELADVFKPGLLEVDHIIPLSLSLSDAQSNKVLVYHSENQRKGQQTPFQYFSSGKAKVTFEKFKEYVNQNSNFTKAKRENLLYLGNPVEGLKGFIKRNLVDTRYASSEFYNLLKSFFEYHKLNTKVKVINGGATNYFRKKAHLSKNRDETHAHHAQDALIIAGFANTKLVKFFSKIGAFSDNFEDKNALIEVDGNIVSTETGEVLNLDLFNKKENISAYIQFLKRIEEIQPLFSHKVDRKPNRGLYDQQIKATRKFVEGNKEETYIITKYSDIYNTGAGNSGSKLKKRILESPEDLLMYHHDVKTFEIFRKIVEQYSEEANPFAAYKADHGPIRKYSKKGNGPIIESVKFRDKKLGSHRINMKQEGKNASVFLKIKSLRTDIYQDGSNYLVLNVPYDMVQFTNSRYIINQDKYYEAKHMQGIPDSAEFVMSLYRGDYITYEEAGDTVEYIFKCLNSEKNHKIEVSYVDRPNDKQLMKGIKTSISNLTKYNVDVLGNKHKVTNEKLKFDVTI

SEQ ID NO: 8657 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILSEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRISKGAYTACLFNLLSDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVIENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8658 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKERDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDVRLGVHRINSRQQGKNKSVYLQIKSFRVDIYQEGEQYKFVNVPYDMLKFSSGVYKVDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8659 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADVILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8660 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILSEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVIENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGIYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8661 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILSEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVIENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8662 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTGEILSEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTACLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVIENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFSSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8663 - protein, 1064 aa, unidentified
  REGION 1..1064: note = Description of Unknown:uncultivated organism sequence
MGYILGLDIGIASVGYAVIDDQYNIITNGVRLFREGTAAENVDRRAFRSSRRGIRRSHHRLERLTALLSTALDSKDDSSYTNIYEIRVKGLSDRLEPSELKAAIIQLTKHRGIFYLSPEDLAVEDGSSQSSADIIRINEHKLKSDIYPCHIQLEKLKTTGVIRGIDNKFTHESYRKELVKLLDVQSKFYSQLEDIKEEILNIYDSKREYYEGPGSYKSPTPYGSYQLDENGNVIKINLIDKMRGRCTYFPDELRAPKWSYSACLFNLLNDLNNLTINGEKITEKQKQELIDEYVNKGKSVTLPAISRVCGVKKEDILGYRIDSSGKAIFTKFDGYNELLKIAKSVNEESLIVGNNQLIDDISEILTREKSLEIRKEQLSEKLGLFAPLAKELAKATGFTAYHSLSFKAINLILNDLFQTTNNQMALYTAAGIKPYNRNWAQGNQLSANLAEWIVSPVVKRSLNETIKVFNALRKYLKKEFGEASEFSDVVVELAREKNSQNKKEHIKKILKDNENRRYQIMELVEGRKLDSVDFQRISLLLEQDFKCAYSLEPIELADVFKPGLLEVDHIIPLSLSLSDAQSNKVLVYHSENQRKGQQTPFQYFSSGKAKVTFEKFKEYVNQNSNFTKAKRENLLYLGNPVEGLKGFIKRNLVDTRYASSEFYNLLKSFFEYHKLNTKVKVINGGATNYFRKKAHLSKNRDETHAHHAQDALIIAGFANTKLVKFFSKIGAFSDNFEDKNALIEVDGNIVSTETGEVLNLDLFNKKENISAYIQFLKRIEEIQPLFSHKVDRKPNRGLYDQQIKATRKFVEGNKEETYIITKYSDIYNTGAGNSGSKLKKRILESPEDLLMYHHDVKTFEIFRKIVEQYSEEANPFAAYKADHGPIRKYSKKGNGPIIESVKFRDKKLGSHRINMKQEGKNASVFLKIKSLRTDIYQDGSNYLVLNVPYDMVQFTNSRYIINQDKYYEAKHMQGIPDSAEFVMSLYRGDYITYEEAGDTVEYIFKCLNSEKNHKIEVSYVDRPNDKQLMKGIKTSISNLTKYNVDVLGNKHKVTNEKLKFDVTI

SEQ ID NO: 8664 - protein, 1062 aa, unidentified
  REGION 1..1062: note = Description of Unknown:uncultivated organism sequence
MELKLGLDIGVASVGWGIIDENYNVIDSGVRLFPEGSAEENLTRRTMRSSRRRIRRMHHRLQRMRILLSNTLAINFPEPQGNIYEIRSRGLQELLSREELFLAVMHLTKRRGTHFLTAEDIEGKNNNGKSTEEILAEQEACLAKKYVCEIQYERYLTDNGKVRGIENRFRNKDYLRELEQLLAVQSKFYDEIEKNADAILEIYKSKREYYEGPGSEKSPTPYGRYRYDENGNVIKIDLIDLMRGRCTYFPDEKRIAKGAYTAYLFNLLNDLNNLKVGERKLTEDEKKYFVKEFIDKGKNITLKIIAKKVVKDENEITGYRIDKNNKPLFTEFKQYKSILKIYQAFDKADYAEGNLDLCDNISEILTRLKSVEERKIALMNYGIEKEIAQELSKVSGFTEYHSLSKKAMDLIMGDLWATDKNQMQIFYDAGMTEVNKNDYIGEEIKFDGSDWIVSPITKRAVAESVKVINAARKLVRRKYGQEFSHIIIEMAREKNSAEEKQNKQKIQRINEERGNAIRELTLGKKITPRQFEIIGLLKEQDMKCAYSGKSVSLTQVYENMLEVDHIIPRSLSFDNSRNNKVAVLVSENQKKGQRTPFQYLNSGAGAITYADYKAMVLKNNSYSARKKANLLYEEAPEKELRGFINRNLVDTRYACREVLNMLQNYFNANEINTKVKVVNGSFTFDFRKKAKLDKDRDATYAHHAQDALIVAGLFNTDLIKKINSIIKMSDSFLDEKKTIIFDNGMVVNTVTGEFVSEADFSANKYIQFIKQIELRPQKYSHKVDRKPNRQLYDQQIKSTRTCLNAKGKEEIYVVTKYKNIYTVGLGSCGDKLKKRILEKPESLLMYRNDQETFKKFREIVDFYNDAKNPFAEYFKEHGPIKKFAKKDNGPEIFDVKFLDGRLGVHRINSRQQGKNKSVYLQIKSFRVDIYQEGEQYKFVNVPYDMLKFPSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 8665 - protein, 1072 aa, unidentified
  REGION 1..1072: note = Description of Unknown:uncultivated organism sequence
MKYRLGLDIGSSSIGWCIFETVNNIPVRIVDMGVRIFTDGRDPQKKTPLAVERRMARGARRQRDRRLQRINALVKQLKSCGLMPESKDAKKLELKNPYKIRAKAVHEEVSLYELGRALFHINRRRGFKSNRKADKGADENESSAMKKAIKDLNEKLGGQTLGEFLYERQNKGENVRVRAETIKNKNIYDMYADRSMYEKEFDRIWNTQSKFHKELTPELRQKIHYIIFNQRPLKVPERGFCQFEKDERREYLAMPISQIYRIYAEVAQLEIIAFEGDDKRLTPSERNAIANELLLNTKKLAKKDGEITFEKISQKILNLPKSTKFNLQSENRKGLFCDKTAFIMSQEECFGADWHKFSFEKQSEIINTILNVSAKPLSDEELEELLSIKYSISKEKAVSILNKAMKLPDGTGSLSALAMSKILPHLKEWNIYNRACALAGYNFNQNYSGEILDKLPYYGQVLKTAALGANPTEENLKFPEKYYGKITNPTVHIALNQVRKVVNKLIDIYGKPDEIVVETARDLPLGEKGISELKKNQEKNKKDNDRIAKELEKVGVKNNYQNRMKFKIWEDLNKDEKQRCCPFCGKQIPLNAIDGLFSRHFEIEHLLPFSETFDDSRNNKVIACKDCNHMYKGKKSPFEAFGHIKDKDNPRNYDAILARAKDFVNAEKRLWRFQEDAMRRFKDEESDLIARTMNDTRYMTRATREYLTSIVEAKNVYTVKGVITGLLRNKWGINKLLNDPALPPEEADEKNRNDNRHHAIDAFILCTISRAMIQRIAQSAKLCEDAGYEKIVSDIGKPFDDFDYEEMKKHLDKMLISFKPDRGNAVNAVKNNKTLGSLHNETALGAINFKDGDNSLTLAKRIKIETLDFKEKNIEEVADEKIKKDLKAIYEEVVLAGADKKVWVEELSKYAKNNSIRRIRIHLRNRPSEKYIPIKDKNGKIYKYYANAENYCMDIYLPSGEKKWHFQPVSMFEAHQKNYVPKWRKTDPHAKLVMRLFKQDILAFEEDGKTVLRKITEIATHGQIGFLPLNVNHIEGNPPKKTPSSLQKLNARKVYIDEAGRLFDPGKAKYSE

SEQ ID NO: 8666 - protein, 1009 aa, unidentified
  REGION 1..1009: note = Description of Unknown:uncultivated organism sequence
MKYGILSRDELEHLYDVPGEDIYKIRVEALDRALDDHEFARLLIHLAQRRGFRSNRRVDAKDTDEGKLLSAVNENARLMKERGYRTVGEMLYKDPKFSTVKRNKEESYSNTVSRSQMEDEVRRIFEAQRKCGNQKASEELEKEYLDIYLSQRSFEEGPGGNAGDYCPYSGNQIEKMVGHCTFEPDEKRAVKASYTFERANLLQNINKMQLIDENGEMYPLNEEQRHALVERAHQTASLDYSKIRKTLNLKETERFAYVDYNQKSTFENAEKKQKFEYLKHYHELRKALNSVEKDLIQKCPVQVRDEIGTILTYYKTDLKIRAALDKIEDPFLTEEVKDAVMGMSGCSGVGSLSLKALNNIMPYLEQGMMYDKAAEAAGYSFRGHDRYNKGMYLPNLSEDDDIRNPVVRRAVSQTIKVVNAIIKKYGKPVAINVELARETARTFEDRQKILKQQKKNREANQKTKRLLQEEFHLLSPSHLDILKDRLFKEQDGICLYSGEKIDRTRLFEDGYVQIDHIVPYSISWDDSYSNKVLVMTRENQQKGNRLPMEYLNGKKQDEFCVRVERQIRDLRKKTNLLMKSIPADKKESFKDRNLNDTKYICRFMLNYLNDHLLFDQSVDMGKRVTALNGSVTAYLRKRWGLNKVRGNGDKHHALDAVVIGCINNSLIMRVTQYFKYRENFLFEPEQHVQKKAEVPSPWPNFREEVEFRMADNPKAFYDRLSTKISLTNYSEEELEQVKPIFVSRMKVKKKTGSANDATIRGLKVLEDGQMVAISKVPLSTLRLDKNGEIKSYYHKEDDRLLYNALKERLEEYGGNGEKAFTEPFYKPKANGEQGPLVRKVKVAEKITNGVVLNHGEGIASNGSMLRADFYRKNGKYYAVPVYVKDMVNDHLPDRAVTLKHPYDQWDKMDDNDFLFSLYPNDVVYIRFNKPKNGKVVNEDSTLNKNESFDEIYGYYKALGIATNSITVITNDNSYRLDSIGIKTLPEIKKCAVDVLGNLIPVARETRKHR

SEQ ID NO: 8667 - protein, 917 aa, unidentified
  REGION 1..917: note = Description of Unknown:uncultivated organism sequence
MLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLEIEKLFSEGYAEVDHIVPYSISFDDSYSNKVIVHTNENQNKGNRIPLNYLSGKKRDEFIVWAKNSHLSFRKKQNLLKEKISEDDFDGFKKRNLKDTQYLSRFLLKFIKKYLKFAPSSTNRKETVIAVNGAITSYIRKRWGIEKIRANGDAHHATDAIVIACVTKSMIKRISEYSKYKETLYIKNNDETLDVDKKTGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8668 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLPDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAALNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLEIEKLFSEGYAEVDHIVPYSISFDDSYSNKVIVHTNENQNKGNRIPLNYLSGKKRDEFIVWAKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8669 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLPDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLEIEKLFSEGYAEVDHIVPYSISFDDSYSNKVIVHTNENQNKGNRIPLNYLSGKKRDEFIVWAKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8670 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLSDIYEIRYEALNRKLTKDEFIRLLIHLSQRRGFKSNRKIDAKNKNSDDGKMLKEIEKNKSIFTDNGYRTIGEMLLKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFSEDEINVALTIPSFTKFGNLSIVVLNKMIPYLEDGMLYNEAITALGYNFKDDDKCQQMYLPSNPKDAPELDEIRNPVVRRTVSQAIKVINSIIREKGESPTYINIELARELAKSYKERKNIESNQKANREKNEKSFEELKKLGVVNPAAFDLVKYKLWKEQDGICVYSQKPLEIEKLFSEGYAEVDHIVPYSISFDDSYSNKVLVHTNENQNKGNRIPLNYLSGKERDEFIVWVKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNDETLDVDKKTGEVKNYFPMPYKWFRTELDIRCSKNPERFLESNPLPTYARDEKVKPIFVSRMVDRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTYDNCYIKKSLGVKNLQSLEKYQVDVLGNVSKVKKEKRMGFR

SEQ ID NO: 8671 - protein, 1086 aa, unidentified
  REGION 1..1086: note = Description of Unknown:uncultivated organism sequence
MSYGLGIDCGIASVGSGTVLLNEKEEPYKIDFMCVRTFDKAETGTGKSLAAERRSFRGSRRTHRRKTHRKDRIKKLICDTMNVDFKYIQSIYERKNLSDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVTLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLNIEKLFSEGYAEVDHIVPYSISFDDSYSNKVLVHTNENQNKGNRIPLNYLSGKERDEFIVWVKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKKYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPNKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8672 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLPDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLEIEKLFSEGYAEVDHIVPYSISFDDSYSNKVIVHTNENQNKGNRIPLNYLSGKKRDEIIVWAKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8673 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLPDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLEIEKLFSEGYAEVDHIVPYSISFDDSYSNKVIVHTNENQNKGNRIPLNYLSGKKRDEFIVWAKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKCEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8674 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRSFRGSRRTHRRKTHRKDRIKKLICDTMNVDFKYIQSIYERKNLSDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIGKMVKNCTFEPTLKAAPKASYSFEYSNLLTKVNSMKILYNGNRRPLTKEEREKVVNLAFKKNKITYSSIKTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNSKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLKIEKLFSEGYAEVDHIVPYSISFDDSYSNKVLVHTNENQNKGNRIPLNYLSGKERDEFIVWVKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPEDDRLLYDALKNHLIKFKEMHKEENGKKKVEDAFTEPFYKPKSDGSKGSLVKSVKIIKKITSSVTLNNNTTIAKNGDMIRTDVFRTEDGYYLVPIYVADTVKNELPHKAIVQGGEWKVMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8675 - protein, 1086 aa, unidentified
  REGION 1..1086: note = Description of Unknown:uncultivated organism sequence
MSYGLGIDCGIASVGSGTVLLNEKEEPYKIDFMGVRTFDKAETGTGKSLAAERRTFRGSRRTHRRKTHRKDRIKKLICDTMNVDFKYIQSIYERKNLPDIYEIRYEALNRKLTKDEFIRLLIHLSQRRGFKSNRKIDAKNKNSDDGKMLKEIEKNKSIFTDNGYRTIGEMLFKNEKFIQRKRNKSDYSMTFLRVDYENEIKVIFNQQRKFNNQHATESFENEYLKIYLSQRNFDDGPDESSPYGGNLIEKMVKNCTFEPTLKAAPKASYSFEYSNLLTKVNSMKILYNGNRRPLTKEEREKVVNLAFKKNKITYSSIRTELGLSNEEFFNISYNSKDYTETEKKTKFSYLTAYYEFKKAYGSSYLEWSVEKKNTLATILTLHKNDSKIIEEMKEKNFLEDEINVALTIPSFTKFGNLSIAVLNKMIPYLEDGMLYNEAITALGYNFKDDDKCQQMYLPSNPKDAPELDEIRNPVVRRTVSQTIKVINSIIREKGESPTYINIELARELAKSYKERKNIESNQKSNREKNEKSFEELKKLGVVKPTAFDLVKYKLWKEQDGICVYSQKPLEIEKLFSEGYAEVDHIVPYSISFDDSYSNKVIVHTNENQNKGNRIPLNYLSGKKRDEFIVWAKNSHLSFRKKQNLLKEKISEDDFDGFKNRNLKDTQYLSRFLLKFIKKYLKFAPSSTNRKETVIAVNGAITSYIRKRWGIEKIRANGDAHHATDAIVIACVTKSMIKRISEYSKYKETLYIKNNNETLDVDKITGEVKNYFPMPYKWFRTELDIRCSKNPERLLASNPIPTYARDEKVKPIFVSRMVNRKVTGPAHQDTLRRMVVENGQKYEVVKTDLNKLSLDNNNEIANYYNPDDDRLLYDALKNHLIKFKEMHKEENGKKKVEDAFTEPFYKPKSDGSKGPLVKSVKIIKKITSSVTLNNNTTIAKNGDMIRTDVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 8676 - protein, 1087 aa, unidentified
  REGION 1..1087: note = Description of Unknown:uncultivated organism sequence
MKYIIGLDMGITSVGFASMMLDDNDEPCRIIHMGSRIFEAAENPKDGSSLAAPRRENRSMRRRLRRKRHRKERIKNLIIQNNMMTADEIDAIYNSGKELPDIYKVRAEALDRKLDTEEFVRLLIHLSQRRGFKSNRKVDAKEKGSEAGKLLSAVKSNKELMVERNYRTIGEMLYKDEKFAEFKRNKADDYSNTFARSEYEEEIREIFRAQQEYGNPYATEELKDSYLEIYLSQRSFDEGPGGDSPYAGNQIEKMVGSCTLEPDEKRAAKATFSFEYFNLLTKVNSIKVVSSAGKRSLNEDERKRVIKLAFAKNAISYASIRKELNLGDGERFNISYSQSDKSIEEIEKKTKFTYLTAYHTFKKAYGSVFNEWSAEKKNHLAYALTAYKNDNKIKKYLTENGFDAVETDIALTLPSFSKWGNLSEKALNKIIPYLEQGMLYHDACTAAGYNFKADDTDKRMYLPAHEREAPELGDITNPVVRRAISQTIKVVNAIIREMGESPCFVNIELARELSKNKAERSKIEKGQKENQARNDRIMERLRNEFGLISPTGQDLIKLKLWEEQDGICPYSLKPIKIENLFDVGYTDIDHIIPYSLSFDNTYNNKVLVMSSENRQKGNRIPMQYLEGKRRDDFWLWVDSSNLSRRKKQNLLKETLSDDDLSGFKKRNLQDTQYLSRFMLNYLKKYLTVAPNATGHKNTIQAVNGAVTSYMRKRWGIQKVREDGDTHHAVDAVIISCVTAGMTKRISEYAKYKETEYQNPETGEYFDVNKNTGEVINRFPMPYAWFRNELLMRCSEDPSRILHEMPLPNYATDEAVAPIFVSRMPKHKVRGSAHKETIRQSFEEDGKKFTVSKTPLTDLKLKNGEIENYFNPESDVLLYNALKERLIAFGGDAKKAFEAPFHKPKSDGSEGPLVKKVKLICKSTLTVPVLKNTAVADNGSMVRVDVFFVEGEGYYLVPIYVSDTVKKELPNKAIVAHKPYEEWKEMREENYVFSLYQNDLIGIKLKKEMKFSLVQKNSTLPKNINVKDGLFYYKGTNISGANISVINNDNTYTVESLGVKRIPVIEKYQVDVLGNVSKVGKEKRVRFQ

SEQ ID NO: 8677 - protein, 976 aa, unidentified
  REGION 1..976: note = Description of Unknown:uncultivated organism sequence
MKYIIGLDMGIASVGFATMMLDEKDEPCRILRMGSRVFEAAEHPKDGSSLAAPRRENRSMRRRLRRKRHRKERIRSLIVDNGIMTLEKIDGIYDAKNPLTDIYQIRAEALDRCLSVEEFVRLLIHLSQRRGFKSNRKVDAQEKKSEAGKLLTAVSANHQLMTEKGYRTIGEMLYRDKKFFECKRNKADDYSNTFARSEYEEEIKAIFRSQQGLGNPYATDKLMDDYLAIYLSQRSFDEGPGGESPYGGNQIEKMIGKCTLEPSEKRAAKATYSFEYFNLLTKVNSIKIISDREKRTLSDGERQAVIQLAFSKNAINYASLRKTIHMTDSERFNISYSQSDKTADEIEKKTKFTYLTAFHTFKKAYGKAFVDWPTEKKNRLAYALTAYRNDSSIITYLTDNGFDKTEIEIALTLPAFTKWGNLSEKALNKIIPYLEQGMLYHEACTAAGYNFKADDTEKRMYLPTRAHIPPEHRKSAEQIEAPELDEITNPVVRRAVSQTIKVINALIRERGESPCFVNIELARELSKSRADRNKIEKGQKENQANNDRIMERLKKEFGLLSPTGQDLIKLKLWEEQDGVCPYSLKPISIERLFEPGYTDIDHIIPYSLCFDDTYNNKVLVMSSENRQKSNRIPMQYLEGKRRDDFRIWVQNSHLRFKKKQNLLKETLTADDLSGFKKRNLQDTQYLSSFMLKYLKKYLALSPNSTGRKNTIQAVKGSATAYMRKRWGIQKIRENGDTHHAVDAVVIACVTSGMIKRISEYAKYKETKYQNPDTGEYFDVDKRTGEVINRFPMPYSWFRDELLMRCSEDPSRVLHEKPLPNYATDEQIAPIFVSRMPKHKVKGSAHEETIRKPYEQDGQQYTISKVPLTSLKLKNGEIENYFNPGSDTLLYDALKERLLTFGGDAKKAFAEPFHKPKSDGTPGPVVKKVKLKKRATLSVPVQQNTAVADNGSMVRVDVFYVEGEGYYLVPIYVADTV

SEQ ID NO: 8678 - protein, 1516 aa, unidentified
  REGION 1..1516: note = Description of Unknown:uncultivated organism sequence
MEGNNKNLTFGFDIGIASVGWAVLSESRVIDLGVRCFDAAEDKDGKPNNQTRRGARVSRNRYRMRSWRLKRLVRLFRDAGMISSDEIKLLIGDQHPKKYKIRSPWELRSLGLSKQLTPYEWAQTIYHIVKHRGFKFYSKIEDPTAVNGPDNQPVGSTATQEQKEFGALKDGLEFTTGLRRKYPQFKTIGNIAWHLANAPQDRDGIYRGPDGEALDIKDCEDFQESFRNKNKSYRHAFHRDDLRDELTVLFDTQKAKGNSFTNYPMPDRANLLDNVQIGSQERTVERNFRDQVFALFELQHPPIYTAQMDALIGRCELEENKLRAPKHCFSNERRTWLETLNHLRIKPSGGKERELSDAERTALIDLPYTLSKVTFKQARDVLREKTGFPMHWREASFTKVSYASKRKNDGSWINVVSADGSRTVLGKYGDEKTRKDANKMLKIQLEAGAISYAELRSLYQVNDGDTFEEQKRDEQVILPSLESQYAIPFDALDNKQAFIKILPAKATKSTTLAKFSKKAMNVLATLRTKKPGATLSDLRLAMEQTETHEIGWQFEFSKKTSIGIQPDHEQSTQIPIEYEDAQAAEAETLIEMKGWHAMRRELESAHSAWWNELQAAWCNASATGEVAKTAATSAANMLDAVAEVLTKAQTDADIRTGLTAIELTSDQAVSLLSTKKIFKDYRNLSLTAIRKILPFLEQKKGYSEACSLAGYKQQTHQRTRHLPPLETYLYERIRHGKKTGYSERRYKDLNNPVVARAFNQARVVLNALIDKHGSPAYVHIELARDIARPLKGRWSGGKYIEGRLDIKRRQDESRNKRKAIRENFSENYKINAPTEQQMLKERLYHEQQSKCAYTLQKLDPNRVVDDENYAQIDHIWPRSITFDNSLDNLVLVHAHANQDKGNRIPFDYINSHPRFGANESLRAEHWRQVQAHILSCKGMADGKIKRLLATELDSEEFLARNLVDTRYTTRLFARMVRDRLLFEGQFEDRTEDIDPSESGKKRLEKFHKTRVRTPQGGVTAFLRRAWLGNIKDREASDKHHAIDACIVAACTPSLIKKVNDWFAHQERAPNQFSRNADGTYTDRRTGETKISKQEARERGLYLIPPDGFRDEFKSKYEQLVVSRAVQKKRNNELHDANPIGHRHYPVKLTDLTQEIFDRIRLPPDLPITRINLIDSVREHFLSCNGDANTAFRHGFKTKNAEGKDKVIHTLPLPLVALPDTFIAKEKQYLPHGSTENFLDTAIKNVPLTSLTLKKLDEKELGTAFYNRNKRMVESIKEQIRKFDGDAEKAFVAPFYPFGPSRPPIKSIRLPAPRGSGIHVRGGASNLGDALYTEMYRYNGTYWFRPRYKISEEASFGLPVMPRGAQHVCNFRKNDFVRIKHPNMAHCYRETRRYRNTNGDTIIEVSAISLDGVFEGYWNYFEPSNDRPVVQLHDASTFFLLEDGKTLKSQSLLLIAKSKAKKAKTKGIDELEYFEFGDVQQDRPLKFSQVRDIKRKVGDAAFIEKVKIDVLGVIDGR

SEQ ID NO: 8679 - protein, 1431 aa, unidentified
  REGION 1..1431: note = Description of Unknown:uncultivated organism sequence
MTGKQKDFGALTFGLDIGIASVGWAVLGKNRIVDLGVRCFDAAEDKDGKPNNQTRRGARVSRNRNQMRTWRLKRLLRLFRDVGLLSKGEIKQLFAATRPKNKTQPINPWVLRAEGLTRKLSPQEWAQVIYYMVKHRGFKFFRKSEDPRNSATNEATPSSNKPAEQKEQDGLRDGLEYTAQLLKKYPQFKTIGEAAYHIANAQQGGDGSYRDKDGKYLDAKDCEEFQESFRNKGKSYRHAFYRDGLIDELGKLFDAQQQPHIANPFADFVLRENIERLHEVQISTETKMVGATFRDQVFALLEMQHPPIYTSQMDALIGKCELEKNELRAAKNTFSNERTTWLQTINNLRIKRNGKEEILTTDERAVLLNLPYTQSKVTFKQARDALRASLGFPAHWREASFTKVTYRNKRKDDGSWLNVVGTDGTKVTLGKYGQETARKKANKELKTRLETGSMTYAEVRQLFQLQDSEVFERVRSEAEIVPLALEGNYTIPDGKKSFVKLLPAKSKKALTLKGRAMHAYTNLCNENPNATLVDLRLAIEQADRLEAGWQFEYSLKDSELIRPENEASTQIPIEYEDAQKAEEETLIELKGWHVFKRALEVECTDWWTSLQIAYLDPQSDVGQTASKQLDAIAELLTKAQTDADVAKGLSELALAESQIKALGKIRFKQYRNLSLIALHKILPSLEAGKSRTEACKDAGYKTVAHQRTKHLPPLETYLYERVRHGKKTKHTELRYKDLTNPVVARAFNQARLVLNALIDRYDSPAYVHVELARDLAKSKDKRIEDKKRQDENRNKKESIRNNFIATYKIGEPSSTQLLKERLYHEQGCKSIYSLKELNLNRILDDPHYVELDHIWPRSRTFDNSMENLVLVLANENQEKGNRIPYDFIKDKYGDEHWRNVNAHVLGCKGISGNKQRRLLAQELDADEFSARNLVDTRYATRLFARMVRDHLLFEGQAEDNIEDIDSSESGKTRLEKFHKTRVRTPQGGLTAFLRRSWLGDIKDREVSDKHHALDACIIAASTPEFILRVNSWFANEEKIPNRFKKNSDGTYTDKFNGSGEIISKQEARERGLYLPPPWEGFRHEFLEKYKSVFVARAVRKKRNNELHDANPMAWKQAYRRVRIPLPELSLEKLDPKRLPVDFYARNYKLIDPLRARLEKFDGDAEKAFAEPFLHAHGNNERPAQLVKAIRLPEPIRKRKLGPEDAQKNRKQFTEPSAHKTVALINLTLDMLKEEKLGEQYYRRNKCVIDALVARLNQYNGNAEKAFGDESNPFYKPLNSERNSKREAPLTHGPRIKSIRLPKNKESGIFVREGVAELGDSLFTEVYWAGESYFFRPRYKAPEQKLFGIANPPKGARPIFAVTQNDLIEVILDDGTQRLGYFVMYEGDGRLQIRDHDQAKKNAHRFGISRIRHLKKLKVSVLGEISDVSSLD

SEQ ID NO: 8680 - protein, 1490 aa, unidentified
  REGION 1..1490: note = Description of Unknown:uncultivated organism sequence
MDGKGLDALTFGFDIGIASVGWCVLGENRIVDLGVRCFDSGEDSDGKPHNQTRRGARVARNRLHMRRWRLRQLLRLFCDAGIIDRPDPKLLMTPPDEDNPWQLRAKGLKEKLEPIEWARVLYHLVKHRGFEFFRKSELKSSQTPDASQPASDQDKPGKEETPAEDASIGKEKEKLNKALEDTGRLLEKYRKPLEAYRDAPLTVGALLVWLEQEDYALGEPSPDQDDRITSFRNKSGSYRHAFFRAALRRELQELFAAQTRYGNPYTTLDLSVDGEYARHMLAQDNSKLTPEKAIPVGSESRPVGQTFQQAVFDLFDLQHPPLYGEQIREMVGKCELIEGQARASKNAFSSERATWLETLNKLRVRRDGKETPLSAEERAALIDLPYKPHKVTLKLVRETLMTQTGFPASWQEASFNVASYQAKPANDGAWIFIASRDQEPVSLAKWANSKERKDKLKEAKKMLMGGIVTFKELRKQLGLADSDRFVSRIKDTTIIPRDREAYEHLQFPSEGDGLLAPGHSFRYISTEGKPKAFPKNVWKFIADLRSQSAATLADWRKAIATVSGMSGTWQFEYSISKEMAIEPKDEVDTQVPLKFEDAQAVEADHKLVELKGWHALRLALAERCPDKWAQLQLAYHRPTSDEGQRAAHGIDDIATILTEAQTDHEIENKLREHGYADTKEIDALQSVNFSKFRNLSLVALYRILPHLENGHIYSKACELAGLSHSEKKAQDRHNKLPPLETFVYKRYRHGKPTGHKENRYKELLNPVVARSFNQARLVFNDLVAKYGSPTYVHVETARDLARSKKMRDKISREQDTNRKRIESIRNDLKSRLGHEPSGEQLLKMRLYLEQNGQCLYTGRSLEPYIDAMLTSDENVVEIDHIWPRSKTFDNSLDNRVLVIAGANQNKRNQIPYEFFNGAGGDPRWREFEMRILACKGISAEKQRRLLSKSLEDADEFLARNLVDTRYATRLFSAMLRERVMFAGGATPEELEAISPDDDGKTRWNRYQRARVRSPQGRLVDFLRGKWGLAHLKDREKSDLHHALDACIIAACSPKTIQQINNYFAEEEQEPGKHSFKRNSDGTYKHRATGEILEKEEAKERGLYLPAPWKPREVMDALNKVFVSRRPKRKSATEIHDAKPKGIRYLPVPLVHLSKEMLSAEKLREIAGRRRENYETLLTALQWANGDAQAAFADGCEVEGKHGKLKRIYSIAMPLWSLPDGYLKQRNKELAKENARRRKDGIKKLNENLSKTARKTVPLTSLTQKMLTEAELGSSYYQRNRELIEALKEHLGDKKAKDAFAQPFQPPPGKKGKKRPVIRSIRLPDTHGSGMLVRGGITGLGESISTEVWLTENGFFFRPRYQAAEEATFGLEEPPTDAKHLFNLRIDEPVEIVLMDGEIIPGDGFPGYFVVYEGDGRIQIRTHDRPGKGKRKKEKSEEAAESTDTAVKNEDEKDNSLRRFSINGIKELKKYRVDALGNYKLVAHAKWSGVA

SEQ ID NO: 8681 - protein, 1473 aa, unidentified
  REGION 1..1473: note = Description of Unknown:uncultivated organism sequence
MAQYIFGLDIGIASVGWAVLSEQRIVDLGVRCFDPGENEKGLPHNQKRRSARVARNRLHMRRWRLRQLLQLFCDVGIIDQPNPQLLAAPPRAKGEPEAGPWQLRAKGLNVPLEPLEWAQVLYHLVKHRGFEFFRKSEIKSSSSSDATSKAAAEPQSPPAGLEEADVDKEKQRLTQALEDSSRLLDKYRKVLDNPNLTIASLLIWLAQDTYVPGAPSPDEKDRIQSFRNKAGSYRHAFYRAVLGQELRALFGAQIKHGNAYTTLQLPKDGQYLRQMLATYGESGIPVGGASRNVGQTFQEAVFDLFELQHPPLYAEQIREMVGECELVEGQPRAPKNAFSAERATWLEKLNHLKVRRNGKEDFLTPSERACLMHLPYAHRVVTLKLVRETLMAHTDFPASWKEASFKAASYQSRPSSGGAWIFIASLGKEPLSLAKWADNKERKERLKKAKEMLAGGVVTFQQLRQQLGLEASERFTCKLQETTVIPRAQESTEHIPFAQKEEGLLIPGQSFRYIPADGKPKAFPKPKAWGLLAALRSHAAPTLADWRAALVLLPNMQGSWQFEHSVQINTAVEQDAEAQTVVPLQFEDAQAVEKDHKLVELKGWHALAKALPGRREQFESAFKDPCSEVGKKAAKDLDHIAATLTECQTDHEIALKLTKLGYTQLEIEALQEVSFSTFRNLSFAAIGKILPHLEEGHVYSEACKLAGFSHSEKNMTRTRRLPPLETYIFQRYRHGKLTGHVEKRYKELRNPVVARSFNQARLVFNALVAKHGSPAYVHVETARDLARSKKLRDKISREQETNRKRTEVLRSDLRNWLGQEPSSTHILKMRLYNEQGGKCIYTGRDLSSEQMLRDEEYVEIDHIWPRSKTFDNSLDNRVLVIAGANRNKSDKIPYEFLDGANESAQWRMFEKRVLACKGMSAEKQRRLLSKSLEDADEFLARNLVDTRYVTRLFSNMLRERVIFSEDAKPEELEAISPDDDGSVRWSRYQRARVRSPQGRLVDFLRGKWGLARVKDREASDLHHALDACIIAACTPRVIGLVNRYFAEEEIDPGRHGFKRNADGTYTHRATGEILSKAAAKERGLYLPAPWDSFHRDLLNALNQVFVSRRPKRKQTDELHDANPKSIRYIPVPLVDLTEDMLSDQRLRGVTGRRRKNYETLRTALQAANGDAIAAFSQGHEIDGVNGKTQRISSIPLPVWSLPKSYLKKLPKTNSKHPKGSASEEKTSRRSVALTDLTKKMLTEFYLGATFYHRNRELIESLKAHLGDKVARDAFAQPFRPPGGTKKGEPRPIIRSIRLPETQGSGMLVRGGVTGMGNSIATEVYWVEGSGYFFRQRYAVDEEATFGQEKPPANAQHFFNLRIDEPVQVVMKDGTTFPASRPGYFVGYEADKRMTIRVHDRPGKGRKKSKETGDEVNDGQAEESPASIIDGEKSGKDSTLFRFSVSGIKKLRKFKVDALGNYRELHAHLHHGLA

SEQ ID NO: 8682 - protein, 1527 aa, unidentified
  REGION 1..1527: note = Description of Unknown:uncultivated organism sequence
MTSKHENLSPLTFGLDIGIASVGWAVLSQNQIVDMGVRAFDAAEDKDGKPNNQTRRGARVSRNRYDMRTWRLKKLTRLFRDVGMLTKSEIKHLFSAQHEKNVKHVSPWQMRAEGLSRPLTKQEWAQVIFHVIKHRGFKFFSKSEDPTKSGNDDADTIDASAKAERDGLRDGLTYTSKLLEKYPQFQTLGQAAHQLANAQQDKNEIYRDSKGNELNAKDCEEFQNAYRNKGKSYRHAFRRDDLIAELNALFDTQHKHDNPYTELALPDGIERLTEIAVSSETRRVEPTFRAQVFALLELQHPPISIEQMDAMIGDCELESEARNGKGKAERRAAKHTFSNERATWLQTLNNLRIKRDGKETTLTEQERNILLNLPYTQSKLTFKQAREILREQNGFPTHWREASFTKLSYRNKRKDDGSWLNIVTTDGTKTALGKYIKSEKERKDINKKLKQRLETGTMTFAELRQLYKLSENETFECQRKNEEIIPVALEDQYPISFDELDHKKAFIKMMPAKSKSAKKLTPKAIRALESLRAKPDASLADLRIAIEQTEELESGWQFEKSQKDIQPIQSANEDKTDVPIEYEDAQKAEEEILIELKGWHTFKRTLENNRPEWWASLQAAWREPQSDAGKTTAHQLDGIAEVLTKAQTDADVKKGFAPLQLDEAKLEALEGIRFKRYRNLSLKALRNILPDLEQGKSYKEACDRAGYQPITPPSRTRHLPPLESYLYERVRHGRTNGFGKTGYSEQRYKDLTNPVVARAFNQARLVLNELIDRYDQSPAYVHIELARDIARPLKGKWSNDKYIEGRLDVQKKQEENRNKRQLIRNNFAETHRISNPSEFQILKERLYHEQQCKCLYTLEELDLDRVVRDENYAQIDHIWPRSLTFDNSMENLALVHAHANQDKGSRIPYDYINSHSRFGSIETQRAEHWRKVAAHVMTCKGMSDNKQKRLLATELDADEFLARNLVDTRYATRLFARMVRDRLLFDGQTEDKTEDIDPSESGKSRLEKFHKTRVRTPQGGVVNFLRRRWLGDIKDRDAGDKHHAMDACIIAACTPKLIHHVNSWFSNQEKVPNQFKKRDDGTYTDKGTGEIISKDEARERGLYLPAPWDGFRHEFLEKYESIFVSRAIRKKRNVELHDANPMALRYYPVNLCELTPEMLDKKQLPPNLPESRLPLIESIRHRLLSNNGDAVSAFKDGFLIKNKKGKESVIHTLPLPIISLPADYFKRTSKQLGKSNKENFKDTAMKNVPLSQLSLKRLSEEKLGSTFHHRNNRMIEAIKAQLNNFKDDAEKAFAEPFYPFGKDRPFIKSIRLPAPCSSGIHVRGGAAKLGDALYTEMYKHDGAYWFRARYKVAQENSFGLPVMPKGAQHIGNFMKNDYVRIKHPNLTHCYREVGRHKDAYGNTLIDVEAIFENGIFEGYWNYFEPSNDRPVVQLHDNSPFFLLEAEKTLDKESLTLIAKPKEKKNSKAKTTEQVEYFEFCETPQDPPLKFSLVGDIKRKVSDAAFIEKLKVSILGSIQEGKDANDLA

SEQ ID NO: 8683 - protein, 1006 aa, unidentified
  REGION 1..1006: note = Description of Unknown:uncultivated organism sequence
MNSYKLGLDIGSRSIGWALLETGMKPSIVDIGVRVFPEGVDRDTTGLEKSKNATRREARGARRVHQRRNLRRDQLVKTLKSAGLLPEDKEQLSELFKKEPYQLRAMGLDEKLDLYEFGRALFHINQRRGFKSNRKTGKVNENNKVAEEADELQKKIREASCRTLGDYFANVNPEENRIREQYTFRSMYEDEFDKLWTKQCGFYPEVLTEDLRKKIRDEIMFFQRPLKPTDDLIGLCELEPEEKCCPRGDWYARRFRMLQDVNNLRVCNPDGSMASLTPEQRRVLLEELNKKKEMKFTAIRNKLGLLETQEFNAEYKVNEKGKKNENLKGDAFSAAMRNNNIFGPKVCDTMYEAEKIKLNDWLVELEDDELTEKLACEYGLDEDQIENVRKISLPQRYMSFSRKAIQKLLPLMEKGKRTDEALDEVYPNRNKTGAIDEKNKLDLPGDLRNPIVNKALFEIRKIVNAIIREYGKPTKIALEMAREVRGNAKERRELHFKMLENENRNKETRKRLTEDLKIRNPSRDDIIKYNLWEECGHSCPYTGKHISQTAIFGENPEFQVEHILPYNRSLDDSYMNKTLCDVHENAHVKGDKTPYEAYSQDEEKYEQIKQRIKALPWPKRRRFLQKEISLDKCIERELNDTRYICKEVVKYLKQIGINVRGTKGRITAELRHQWGLNSILDLAIKDMKNRDDHRHHAIDAAVVSVTDNKHLHKLAQSKYSTTGHSFTQPWPNFREELAEKVKHINVSHRVTRKVSGALHEETAYGPTGKIDEKGQEYYVFRKKLEDITPAMIKKEKIVDTVVQQIIKDRLTEYGIDPEKAKKLPKEVWNEPLYMKTKKSKKKVPIKKVRIQDVFNNMILLKDKSGKPYRAVATGNNHHIEIFEYKDKKEQTKRDGKVITMFKAVQRSQRGESVVCRDYKNGKNFVCSLAQNELFMIYLNDDSTELHRVQKITQSGNNITITLRPHTYAGKVSDFDKPPLVQRRTPNTLKGHKVTVDMLGRVHLAND

SEQ ID NO: 8684 - protein, 973 aa, unidentified
  REGION 1..973: note = Description of Unknown:uncultivated organism sequence
MKSYTLGLDIGSKSIGWTLLRDKPKPSIVDIGVRVFPEGVDRDTKGAEKSKNATRREARGARRVHQRRNLRRDKLVKTLRASGILPEDEQELQELLKKEPYQFRAKGLDEKLELFEFGRALFHINQRRGFKSNRRTGREKEDGKVAKEAGELQKEIEGAGRRTLGEYFAGLNPEEQRIRDQYTFRSMYEEEYDKLWEKQSEYYPEVLTDELRGKVRDKIIFFQRPMRWDPDMIGDCELEEGEKRCPRGDWFARRFRILQDVNNLKIHSPDGTKRGLEDDERRIILKELDAHEKVKFSSLRKKLGLLETQEFNAEYEINEKGKKRDKLKGDEFAAAMRSRNVFGAKRWDSMGEQEKIELNDACLELDDDELREKMTDEYGFTKEQAERVLKVPLPQRYMSFSRKAIRKLLPLMEAGKRTDEALDEVYPDRNKMEEIKEEDKLPLPEDLRNPIVNKALFEIRKLVNAIVREYGRPGKIVIEMARDVKGNLREREEIQFKMRENERRNDEARTRLIQDINILNPSRDDIIKYKLWEECGRICPYTGKQISQVDLFINPVFQVEHILPYSKSLDDSYLNKTLCCVNENRLKGNQTPYEYYHGDKKKFEEIKQRVNRTAMPYWKKRKFWQEKVNTDKIIERELNDTRYICKEVVKYLKQICRNVTGTRGKVTAALRYQWGFIKDRDDHRHHAIDATVVAVTKQKHLRELAQSKYSSEGIRFNPPWLHFREELAEKVKHIDVSHRVTRKVSGALHEETHYWKEENGPHAGKFITSKPLDGKFTNNFAEHICDDTVKKLVFERLSEYDYEPKKAFAEPIYLKNKSGNPVPIRKVRVWKESYTLKKIRGNIWVEPGSNHHIEIYEYTDGKKKGKRDGEVVTMFEAIRRKKDGEPVVNREHGPDKKFVCSLSINEMFMLESDNKEYYLCRIQKMSQNKVIVLRPHTFAGNLKKQKPINKTPNSLKGYKVTVDPLGRIHRAND

SEQ ID NO: 8685 - protein, 997 aa, unidentified
  REGION 1..997: note = Description of Unknown:uncultivated organism sequence
MYTLGLDIGSNSIGWAILNPEKQEVINAGVRIFQEGVDRDTKGAEVSKNAARRAARSARRTRRRRNYRKDKLFRLLVRNGLLPQDPRQIQSLFQKDPYYLRAKGLDEQLEPYEIGRVLYHLSQRRGFWSNRKSEKKKEEGVVAKEAAQLQKQMTETGARTLGEFFARLNPHEQRIRGHYTFRSMYEDEFEKIWSTQSQFYQTILTDVLKHQVKDQTIFYQRPLKPSDELIGNCELEPNEKRCPKADWHARRFRILQVLNNLEIHNPNGTEQKLTEDQRKIVFQELLTSKEVKFDTLRRKLNLLETQTFNLEEGPKNQKKDSLKGDEFNAHLRKVLGRRQFERLTEEDQIDINTLLLDDTLQDEEVVEKLMERYGFTQEQAQEILEVPLPQKYMSFSRLAIQKLLPFLEQGMLTHQAIEAVYGSPQAPRSHQTLDRLPFPEDLRNPIVNRALWEVRKVVNALIRVYGKPAKIKLEMARELKGSKREREEIQFRQRQNEQENETARQELVRMGILSPSRDDIIKYKLWQECGQVCPYTGRPISQEALFGPHPEFQVEHILPYSRTLDDSYMNKTLCAVDENRRKGDQTPYEFYNGTEQFEQILQRVAKLPYPKRRRFWQQQVELDNFIQRQLNDTRYISRKAVEYLKTLGCTVQGTRGQVTAELRHQWGLNSILDDSYLGEEKKRDDLRHHAIDAAVVAVTENRHLRDLAASKYTPAGRAAARFAPPWEGFRNQLQKIVNQINVSHRVTRKVSGPLHEETSYGPTGLKDDKGQDIYVYRKPLESLTLAMVPKIVDPVVRQIVTARLEQFGLQPAGEGKISKEVWKEPLRMKTKDGRPGPLIKSVRIRDVFNNLIPIKDKDGKPYRYVAPGSNHHIEIFEYTDAKGKTRREGRVISMFEAVQRSRRKEPVVCRDYGDGGKFVCSLSKNESFMLKMDDGNFVLHRVQKIIQDGRIVLRPALFGGKVSDSDSPPLIQRRNYSTLDGYKVSVDPIGRIFPAKD

SEQ ID NO: 8686 - protein, 1004 aa, unidentified
  REGION 1..1004: note = Description of Unknown:uncultivated organism sequence
MASHTLGLDIGSNSIGWALLHLTKNPTILDMGVRVFPEGVDRDTKGLEKSKNVTRREARSARRTHQRRSLRKEQLLRTLQTAGLLPKDDSQLRSLFQINPYQLRKKGLDEKLEPYEFGRVLYHLSQRRGFKSNRKSGKPKEDGVVIKAGNALQAEMDNKKCRTIGEFFASLNPEEQRIRARYTFRSMYEKEFDLLWTKQAGFYRDTVAEDLEKKIRDGIIFYQRPMRWDPDRIGNCELERDENGKPLKRCPRGDWYARRFRLLQDVNNLRVQNPDGSEDKLSEEQRKPILEGLEQKEKLSFDEIRTKIGLMETQKFNAEYRIGPKGKKVESIKGDVFAAKMSGRSIFGAKRWDALDEQERIRLNESLVDLEDDQLRENLRSEYGFDDKQIEAVLKISLPQGYMSFSRKAIQKLLPKMEEGLLTHEAIKEVYGERQTNVGGEQTEKLGDPPELRNPIVQKALYEVRKVVNALVREYGKPERIKIEMARDVQGNRRQREELHWKMRENETRNENTRKRLIEDIGIRNPSREDRIKYNLWQECDRRCPYTGRQISQEALFGLNPEFQVEHILPYDRSLDDSYMNKTLCHVDENRVKHDKTPYEAYSHDPDRYEQIKQNIKVLPWPKRQKFLEQKINLDTHINRELNDTRYICREVIAYLEKMGVPVRGTRGKITAELRHQWGLDGIFKEIGTNRDDDHRRHAVDAVVVGVTENEHLRRLARSKYSVTGVSFEAPWDNFRDEMRERVRHINVSHRACRKVSGKLHEETNYGPTGKKDENGQDIYVYRKPLDALTVPMVEKIVDPVVQEIVKTRLVEKGISLDSGDRKIPKEVWKEPLYMRTTKSDKKVPIKSVRIHDVKTNVKPLKDKTGNVYRVVEPGSNHHIEIFEYTDKKGQVKRDGTVVSMFDAVQRSQRGEPVVFRDYGDGGKFVWSLAINEMFMLETDSGQHVLHRVQKMDQNKRVTLRPHTYSGKLSDYDVSPLIQRKSPGTLRGYKVMVDPLGGIWPAND

SEQ ID NO: 8687 - protein, 996 aa, unidentified
  REGION 1..996: note = Description of Unknown:uncultivated organism sequence
MSNYTLGLDIGSNSIGWAILDLGDKPSIACLGVRVFPEGVDRDTKGLEKSKNATRREARGARRTHHRRNLRKQQLLNILQANGLLPKDVSQIKSIFQREPYGLRKKGLNEKLEPYEFGRILYHLSQRRGFKSNRKSGKAKEDGVIEKDAKALSAEIDKKGCRTIGEYFSQLNPEEQRIRGKYTFRSMYEKEFDLLWEKQKEFYPEVLFEDLRKKIRDEIIFFQRPLKPTNELIGECELEPGEKRCPRGDWYARRFRLLQDVNNLIIQNPNGIEELLSTERRKILLDELGQKEKLTFDKIREKLGLIESQKFNAEYKISRSGKRVESMKGDVFAAGMRSKNVFGSKRWEGMDEQEKIKLNEWIVELEDDQLKEKLQSEYGFDDKQIEAVLKISLPQGYMSFSRKAIIKLLTSMEKGKRTDEALDEVYPDRNKMDEDEQKNKLDLPPDLRNPIVQKALFEVRKVVNAIVREYGRPARIKIEMARDVQGSSRQREELHWKKFENEKRNEEARKRLREDIGITNPKRDDVIKYNLWEECGKTCPYTGRQISQEALFGSNPEFQVEHILPYDRSLDDSYMNKTLCEVHENIHVKKGQTPYEAYSHDQEKYEQIKQNIKVLPWPKRQKFLQKEIDLDQHIARELNDTRYICREVVRYLKQLGVYVKGTRGKITAELRHQWGLDGIFEELGVRRDDDHRRHAVDAVVVGVTENEHLRKLARSKYSVTGILFEKPWPDFREEVREKVKHIDVSHRACRKVSGKLHEETNYGPTGEMDENGQDIYVYRKPLDALTLPMVEKIVDPVVQEIVKNRLIEKGINLEAGNRKIPKEVWKETLYMKRTKSNKQVPIKKVRVRDIFNNMILFKDDSGKKYRAVTPGSNHHVEIFERTDKNGCIKRDSKVITMFEAVQRSQKGEPVVKRDYGDGKKFVCSLSINDMVMMKNKAGETDLYRVQKMDANKMVRFRHHTASNLDRKETYIDKTAHLFEGYKVTVDPLGRVLLAND

SEQ ID NO: 8688 - protein, 1022 aa, unidentified
  REGION 1..1022: note = Description of Unknown:uncultivated organism sequence
MPNILGLDLGTNSIGWALLESSDDKGNDITGIVDTGVRIFQEGVDRSTTGAELSKNASRRAARGARKLHKRRNQRRYDLKEALINHGLLPEEGSQTWHTIMQSNPYMLRSTLLQLKQSQVDKEADKLLFAFGRALYHLNQRRGFKSNRKAGESDGKVATALTELQQQMDDGNFQTLGQYLYSLNPKEQRIRGKYTKRSMYEKEFDALWSHLSSFYPKKLTESLKYELRNIIFYQRPLKNQKNLIGLCELEKRIAINKKEEKVWTGKKRSPKGTWYAQQFRMLSEINNLTVMDDDKEWQLAEDLELRDKLVAAMQKKKTMNFSAIRKLLFSKDDQPWEHLRFNLEEGGRDKLQGNASEASLRGALKKKYDVLSIEQRDTLIHDLIFLEDETILRRHCEALDFDEEETQKIMKIKLEDSYFRLSQKAIKKLLPFLEEGLKYSDAVEAAGYLRKDQQEEQIVAQLGEPPQLRNPIVQKALFEVRKVVNAIVHEYGLPAKIRIEMARDLKQSTGQRKEVSFQNAKNRKRNDEIRVRLINEYGIHNPSRDDVIKYRLWEECNHTCPYTNTTISAAMLFSSEVEIEHILPYSRTLDDSYINKTLCMSSENKTKGNQTPYEAYHADYERYQTMLAGVRKFKPPFGYKKWNKFRQKEISLDSFIERQLNDTRYISREVLSYMEPLVGKKNVQSGRGQMTSTLRHLWGLNKILHKSGEKTREDHRHHAVDAVVTALSTPKALESVSAASKYGRLDKLSIEQFPVPWDGFHHDVEEKIQGIIISHRVMRKIRGALHEETAYGELKFTDDKNRKMYAVRKAVSALSHKEITQIADEKIRGAISSYILQKGFDPKEKTDVAKALKDADKNPPTMQSGQVIKKVRLHKPFSKMRMLKNKQGHEYRAMQEGSNHHIVIYEYEDKKGKTKRGGVVVSMFDAAERAKTGKPIIQRELGEGKRFVMSFSINELVQVPKREDGFDVYRVQKMNAATQITLRLHTAANINDNSARLLVQPNTFKGSKVVIDPLGNMFPAND

SEQ ID NO: 8689 - protein, 1004 aa, unidentified
  REGION 1..1004: note = Description of Unknown:uncultivated organism sequence
MSGYVLGLDLGSNSIGWAAVRKDDEDDQPAVQAGVRIFPEGVQQPNTMREKPRGQQRREARSARRVHQRRNHRRHALREALTEVGLMPGDQKDLDAVFRMEPYALRAKALDHRLDPHEMGRVLYHLCQRRGFKSNRKSSGDGKEGEVKKATAQLADAMSEAGSRTLGEYLARFVRADGTSRDHARTDLPRIRYRYTLRSMYSEEFDAIWEAQQPHHPDVLTDELRSRVHHIIFYQRPLKYRKEVIGDCELEPGEKRCSRGHWLAQQFRLQQEVNLLKLVEADTGEERPLTEEERTTLVEALTPKSKMTFDQIRKILDLHDADTFNLETAAGRKNLSGNPIERALRAKPLGKWYETIDDQTRDQLYDALAEVEDPAELERLGREEWDLDEKQVTKLLAISVPTGRFRLSLKAIRKVMPFLEAGHIYSEAKEKAGYDIVRKVEVHDNLLPVDQVVPNLTNPLVHRALAETRKVVNRLIREHGIPDEIVIELAREMKSSRDRRRKRHFENLDRRRENDDIRSRLISEFDIPNPSRADVIKYRLWQECERVCPYTGRTISAAKLFSNEIDVEHILPYDRTLDDSYMNKTLCFADENRRKGKQTPWEAYGTDEERFEEIIQRVRNLPYPKRKRFAQKEVKLEGFVERQLRDTCYISRQSVAYLRTLGCTVRCVKGATTAVLRHEWGLNGLLDDGPVEGKTRDDHRHHAVDAAVVALTTRSALQRLSSARFDRQTEMPPPWPSLRQDMIEALGEIRVSHRHDRRLGGAMHKEMIYGPVDRRGEGVRRAPLRKLSWNRVSDIRDDAIRAIVQKAVKEACQAEGIELKPSDPLSKALGDQVVCMPSGVPIKKVRFLTRDSSLRPLDDSDGSPATKLVLPGSNHHLAVYEKDAGAWTGRIVSRFEAYRRRREGLPIVSREPLDGMGFVMSLCLRDMLLMQDPDTGRDELWVVKAFSVGKTPRFQPDIQIIRHTTAHPGKHGDLRITNWETKFRKLNPRKVSVDPIGRISACND

SEQ ID NO: 8690 - protein, 540 aa, unidentified
  REGION 1..540: note = Description of Unknown:uncultivated organism sequence
MAKVLGLDLGSNSIGWALLESSDDRGNNFTGLIDTGVRIFQEGVDRTTTGAEISKNAQRRSARGARKLHKRRNQRREALKALLIQHGLLPESQAEFETLMQTNPYELRAKGVDEKITLYEFGRALYHINQRRGFKSNRKAGESDGKVATALVELEKQIQDGGFKTLGEYLYSLDPKEQHIRRRYTKRSMYEDEFKILWEHLSPFYPDKLTEELKSKVFYTIFYQRPLKVQKHLVGLCEFEKREVVNRQGEKVWTGKKRSPKGTWYAQQFRLLSEINNLKVIDGNDEWQLAEDLDLRDKLIAALQKKKTMNFSAIRKLLFEKNQHGFEHIRFNLEEGGRDKLKGNEAEASLRSILKKKYDALTEKQRDTLIHDLLFIEDEKVVRKHCEQLGAALELTEEQVEKLSKVKLVDGYLHLSEKAIKKLLPHLKQGLKYSDAVEAAGYLRKDQQEERIVPRLGEPPQLRNPIVQKALYEVRKVVNAIVWEYGKPDFIRVEMARDLKQSASQRKEASFQNARNRKRNEEIKNRLQKEYGIHNQAVMM

SEQ ID NO: 8691 - protein, 1010 aa, unidentified
  REGION 1..1010: note = Description of Unknown:uncultivated organism sequence
METELVLGLDLGTNSAGWALIEHSVGADGLAKPTRLVDAGVRIFPEGIEAKSSESRNVARRAARGMRRQHDRRNRRRDALRHRLQRAGLLPCEKTELAAVLSANPYALRARGLDEKLEPFELGRALYHLGNRRGFKSNRKTERKTNKKDKDTVQTAITDLQKKIEDAKARTLGEYLSRIDPFKERTRCRYTSRAMYEHEFDALWDAQRPNHPAILTDDLRRQIHETIFNQRPLKVQKNLVGKCELEPTRKRAPKGLWYAQQFRLLQDVSHLEVLDIKTGEIRKLNDGERKELIAELQKKQTMTFDQIRKTLGMLDGQKFNFETANHRDKLKGNSTEARLRKALAKSYDQLTAQTRDEIVRDLLYLDDADVIRSHAISRWKLNEEAAEKLAGIDLESGYLHLSERALRKLIPHLEQGLSYMEAVVAAGYERPDQRKIEVRKELTREDMPDLRNPIVTVAMNQTRRLVNAIVREHGKPARIRVEMARDLKVSLKKRSEILSENKKNRLENETTDKILEQDFGISNPSRDDRVRYRLWKEAGYACPYSGQTIPKQSLFSPDWEVDHILPLPLSGDDSYLNKVLCATAANRDKGDRTPWQAWHGEETRWDEIVHRIKVLPWPKRKRFEVKEIDTDVFIARQLNDTRYIAREARSYLETLTGKNGVQVGKGGVTAALRRRWGLNGILSDSGEKTRADHRHHAIDAVVIALTTVGVVKRMSRLSALGRRPEDAGFPPPWEHFRDDVKRRVETMLVSHQAQRGLRGPLHEETNYGILGLKDEKGNELFAVRKSLAAMTQSELERVADNNVREIVKAHLRAHGADPEARNAEKTEQWKKAMTPPNYPTLPNGNGAPVPIKKVRLHKPSGGMIRMKNRDGVEYRAVESGSNHHIVIFEHTAEGKKKGGWDGEVVSMFEAAQRIRRHEPIIRRDLGEGKKFVMSLSINEIVKVTENGESAYWRVQKIDAGNMRVTFRPQNDARKSEDKSFEKTIGVGPLKKLAPAKVTIDPVGREHPAHD

SEQ ID NO: 8692 - protein, 1010 aa, unidentified
  REGION 1..1010: note = Description of Unknown:uncultivated organism sequence
METELVLGLDLGTNSAGWALIEHSVDADGLAKPTRLVDAGVRIFPEGIEAKSSESRNVARRAARGMRRQHDRRNRRRDALRHRLQRAGLLPREKTELAAVLSANPYALRARGLDEKLEPFELGRALYHLGNRRGFKSNRKTERKTNKKDKDTVQTAITDLQKKIEDAKARTLGEYLSRIDPFKERTRCRYTSRAMYEHEFDALWDAQRPNHPAILTDDLRRQIHETIFNQRPLKVQKNLVGKCELEPTRKRAPKGLWYAQQFRLLQDVSHLEVLDIKTGEIRKLNDGERKELIAELQKKQTMTFDQIRKTPGMLDGQKFNFETANHRDKLKGNSTEARLRKALAKSYDQLTAQTRDEIVRDLLYLDDADVIRSHAISRWKLNEEAAEKLAGIDLESGYLHLSERALRKLIPHLEQGLSYMEAVVAAGYERPDQRKIEVRKELTREDMPDLRNPIVTVAMNQTRRLVNAIVREHGKPARIRVEMARDLKVSLKKRSEILSENKKNRLENETTDKILEQDFGISNPSRDDRVRYRLWKEAGYACPYSGQTIPKQSLFSPDWEVDHILPLPLSGDDSYLNKVLCATAANRDKGDRTPWQAWHGEETRWDEIVHRIKVLPWPKRKRFEVKEIDTDVFIARQLNDTRYIAREARSYLETLTGKNGVQVGKGGVTAALRRRWGLNGILSDSGEKTRADHRHHAIDAVVIALTTVGVVKRMSRLSALGRRPEDAGFPPPWEHFRDDVKRRVETMLVSHQAQRGLRGPLHEETNYGILGLKDEKGNELFAVRKSLAAMTQSELERVADNNVREIVKAHLRAHGADPEARNAEKTEQWKKAMTPPNYPTLPNGNGAPVPIKKVRLHKPSGGMIRMKNRDGVEYRAVESGSNHHIVIFEHTAEGKKKGGWDGEVVSMFEAAQRIRRHEPIIRRDLGEGKKFVMSLSINEIVKVTENGESAYWRVQKIDAGNMRVTFRPQNDARKSEDKSFEKTIGVGPLKKLAPAKVTIDPVGREHPAHD

SEQ ID NO: 8693 - protein, 980 aa, unidentified
  REGION 1..980: note = Description of Unknown:uncultivated organism sequence
MNSYTLGLDIGSNSIGWALIEIGKNPSIINMGVRIFPEGVVRDTKGLEKSKNQTRRESRGARRTHQRRNLRKERLLNILQTVGLLPKDESELRSLFHTNPYQLRKNGLDEILEPYEFGRVLYHLSQRRGFKSNRKSGKAREDGVIIKGANALQTVMDTKRCRTIGEYFAGLNPGKKRIRSQYTFRSMYEKEFDLLWAKQAAFYPEILTDELHRKIRDEIIFFQRPLKPTDELIGKCELEPGEKRCPRGDWYARRFRILQDVNNLKIQNSDGTESKITKEQRSFILDELSKKKELKYEDIRKKMGLMKTQVFNLEQDGKVKTLKGDVFSAVMRSKNIFEPKFWDAMNEKEKIKLNEWFVELEDDQLREKLRSEYCFDDKKIETVLKISIPQRYMSFSRKAIIKLLEFMEQGALTSEAITLSYRDKGKDKDSSDVCDRLPLPEDLRNPIVNKALFEVRKVVNALVREYGKPAKIKIEMARDVQGSRRQREELHWKMRENEKINENARKRLREDIGINNPTRHDVIKYKLWEECGKRCPYTGKHISQTAIFGSNPEFQVEHILPYDRSLDDSYMNKTLCEVHENIHVKKNQTPFEAYSHNPEKYEQIKQSIKVLPWPKRQKFLKQEINIDNHINRELNDTRYICREVVEYLKKLGVNVRGTRGKITAELRHQWGLDGIFDELGTRRNADHRRHATDAVVVGVTENEHLQKLARSKYSVTGVSFYPPWHGFREDVREKIDQINVSHRVCRKVSGKLHEETNYGPTKNKGLYVFRKELKNLTLPMVKNIVDPVVREIVKKRIEEKGSDFWKEPLYMKTTKSNKKVPIKKVRVYNVAENVIPMKDLSGQIYRYVETGSNHHIEIFEYKDKKGNIKRDGKVVTMFKAVQRSQHEEPVVQTNHGADKKFIFSLAINDMFNLELEDGSKILHRVQKIDKNNRIILRPHTYSGKVSDYDKPPSIQRKSASTLLGCKVTVDPLGKIWPAND

SEQ ID NO: 8694 - protein, 997 aa, unidentified
  REGION 1..997: note = Description of Unknown:uncultivated organism sequence
MTSYTLGLDIGSRSIGWAIIDKINKPAIANMGVRIFPEGVDRDTKGLEKSKNFTRREARGSRRSHQRKNQRKKQLLTMLQNAGLLPKSETELTALFRYNAYQLRKKGLNERLELYEFGRILYHLSQRRGFKSNRKNRKSKEDGIVIKAASALQTDIDNKGCRTIGEYFAGLNPEEQRIRGQYTFRSMYEKEFDLLWSKQKEFNPELLTETLRIKIRDDIIFFQRPLKPSDELIGSCELEMGEKRCPRGDWYARRFRRLQDINNLIIQNPDGSENKLTNDQRNILIGDLCQKEKMSFDKIREKIGLMETQKFNLEQDGKIKFLKGDIFTAKMRSKNVFGSKRWGQMDEQEKIEINTAFLEFEDDKLIEKMKTKYGLDEKQIDVAMKVSLPRGYMSFSRKAIIKMIPFMELGCLTHEAIEKAGYERNRSTNAESVQKLPLPSDLRNPIVQKALFEVRKVVNAIVSEYGKPEKFVIEMARDVHGSRRQREELHWKMRENEKINEQARKRLIEDIKIDRPKREDIIKYKLWEECGKTCPYTGKHISQTALFGTNPEFQVEHILPYDRSLDDSYMNKTLCEVHENIHIKKGQTPYEAYSNNPEQFEEILERVNKSMMPYPKRKKFWQKEINLDQQIARELNDTRYICREVVSYLKQLGIYVKGSRGKITNELRHQWGLDGIFDELGSRRDDDHRRHAVDAVVVGVTENEHLKKLAISKYSLTGVQFEQPWENFRDEIREKVKNINVSFRVQRKVSGALHEQTSYGPTGKKDENGQDIYVYRKSIDALTVPMVQKIVDPVVRAIVKNRLMEKGIGIDDGDRKIPKEVWNEPLYMKTKKSDKIVLIKKVRIADVFKKMIPIKDKSGNPYRYVAPGSNHHIEIFEYKDKKGRTKRNGNVITMFEAVRRSQRSEPVVQKDHGPNKKFIFSLARNEMVMLDIGDGKEILHRVQKIIQDGRVIFRPHTFGGKLSDSDQPPSIQRKSASTLKGYKVIVDPLGRIYRAND

SEQ ID NO: 8695 - protein, 1005 aa, unidentified
  REGION 1..1005: note = Description of Unknown:uncultivated organism sequence
MNSYTLGLDIGSNSIGWSLMDMGERPAIIDMGVRVFQEGVNRDTKGLEKSKNATRREARGVRRTHQRRTLRKQQLLSVLQSKGLLPNDESKLVSLFHTSPYELRKKGLDEKLEPYEFGRVFYHLSQRRGFKSNRKSGKAREDSVVIKWANALQTEMDSKKFRTIGEYFAELNPDEKRIRGKYTFRTMYEKEFDLLWAKQAEFYPEVLTEDLRKKVRDEIIFFQRPLKPTDELIGECELEPGEKRCPRGDWYARRFRLLQDVNNLIIQNPDGTEEKLSNQPDHRKILLDELGQKEKLTFDKIRKKLGLLETQKFNAEYKIGRGGKTVESLKGDNFSAGMRSKNVFGPKKWDEMDEQEKMKLNEWIVELEDDQLREKLRGEYGFEDKQIEAILKISIPQGYMSFSRKAIINLLEFMEQGAITSEAIDVAYRDRKTTGGENDLDKLPPTEDLRNPIVNKALFEVRKVVNAIAREYGKPARIKIEMARDVQGSQRQREELHWKQWENKKRNEGARKRLREDIDISRPTRDDVIKYKLWEECGRRCPYTGRHISQEALFGPNPEFQVEHILPYDRSLDDSFLNKTLCEVHENIHVKKNQTPYEAYSHDTEKYEQIKQNIKVLPWPKRQKFMQSEINLEKHIERELNDTRYICKEVVKYLKRLGVNVKGTRGKITAELRHQWGMDGIFDELGVRRDDDHRRHAVDAVVVGVTENEHLRKLARSKYSVTGMFFDLPWQNFREEVREKVRHINVSHRVQRRVSGKLHEETNYGLTGKKNEKGQDIYVYRKPLDGLTIPMIKDIVDTVVREIVKNRLLEKGIDLNAGDRKIPKEVWKEPLYMRTKKSDKKVPIKSVRIHDVKTNVILMKDNTGKVYRVVEPGSNHHIEIFEYTDKKGNVKRDGKVISMFDAIQRGQRGESVVCKDYNDGKNFVCSLAQNESFMLELDEDSTELHRVQKITQSGNNITITLRPHTYSRKVSDSDKPPLVQRRTPNTLKGHKVTVDMLGRVHMAND

SEQ ID NO: 8696 - protein, 999 aa, unidentified
  REGION 1..999: note = Description of Unknown:uncultivated organism sequence
MTAYTLGLDIGSKSIGWALLDEKENKIINLGVRVFPEGVDRDTKGLEKSKNATRREARTARRNHQRRNLRKEQLLRTLQAEKLLPLGNSGLKSLFHTNPYKLRKKALDEKLDPYEFGRILYHLSQRRGFKSNRKTGKTKEDGFIIKGANALQKEMDDKNARTIGEYFAGLNPDEKRIRGQYTFRSMYEKEFDLLWTKQTEFYPDILTEDLQKKVRDEIIFYQRPMKWNPETIGNCELESGEKRCPRGDWYARRFRLLQDVNNLIIQNSDGSERNLNDEQMKGKREKLLSELSKKKDITFDKIRKLLGLIKTQKFNAEYKIGRSGKHVKSLKGDTFTAGMRSKNVFGVKRWDAMDEHEKMNLNKWLIELEDDQLREKLRAKYGFTDNQIEAALKISVPQGYMSFSKKAIVSLLEFMEQGALTSEAIAQAYPNRKATSEENKGLDRLRPPESLRNPIVNKAMFELRKVVNAIVREYGKPAKIKIEMARDVQGSKRQREELHWKIFENEKRNEEARKRLREDIGIRNPRRDDVIKYNLWVECGKRCPYTGRQISQAALFGPNPEFQIEHILPYDRSLDDSYMNKTLCAVRENIHIKRDQTPYETYGHHPERYEQIKQNIKHLPWPKRRKFLQKEIDLDQSITRELNDTRYICKEVVRYLKKLGVYVRGTKGKITGELRHQWGLDGVFDELETKRNDDHRRHAVDAVIVGVTENEHLRKLARSKYSVTGARFEPPWPDFREGIREKVKQINVSHRMQRKVSGKLHEETNYGMTGKKDEKGQEYFVYRKKIEDLTVPMIEKIVDPVVRDIVKQRLTKKGIDLSKRGKIPKEVWKEPLYMKTTISDNKITIKKIRVQEVFNNMIVMNDIQGRPYRAVAPGSNHHVEIWEYTEGPKKGKRDAEVVSMFEVVNRSRRGEEVVNREHGVAMRFVCSLAINDMVMLSNNYGEMDLFRVQKMNVNKQVYFRHHTASQIDDDTTVIRKQANLFDGYKVTVDPLGRVWPAND

SEQ ID NO: 8697 - protein, 990 aa, unidentified
  REGION 1..990: note = Description of Unknown:uncultivated organism sequence
MKSYTLGLDIGSNSIGWALLQDGKKPSIVGIGVRVFPEGVDRDTKGLEKSKNATRRETRGTRRVHQRRNLRRDQLVKALQSVGLLPESKKELNNLLGKTNPYELRKRGLDGKLELYEFGRVLFHINQRRGFKSNRKSDKKKEDGLIAKGAGELQKRINDAKCRTLGEYFADLNPEKERIREQYTFRSMYEEEFDKLWDKQAEYYPDVLTEDLREKIRNEIIFFQRPLKPTEELIGPCGLESEEKRCPRGDWYARRFRLLQDVNNLKIHNSDGSVNELTEEQHQIILVHLSKSKEVKFSKLRKVLGLLETQEFNAEYETNEEGKKREKLKGDEFNASMRSKKIFGPKVWDAMEEVMKIKLNGWLVDLGDDELIEKLTAECGLNEGQIEAVLKITLPQRYMSFSRKAIQKLLPLMEAGKRTDEALDEVYPGRNKVEEINEEERLPLPEDLRNPIVNRALFEARKVVNAIIQEYGKPKKIAIEMARDVRGNARQRKELHFKMLENEKRNEQTRKRLVEDIGIANPSRDDVIKYNLWIECGTICPYTGREISQEALFGQNPEFQVEHILPYDRTLDDSFMNKTLCYVNENRLKGARTPYEFYNGDENKFEEIRQRVNKTKMPYWKKQKFWQKEINTEKIISRELNDTRYICKAVVRYLKQICPNVAGTRGKATAELRYQWGLIKDRDDHRHHSIDAVVVAVTEQKHLRELAKSKYSIDGIVFRQPWPHFREEVEEKAKHINVSHRVQRKVSGALHEETSYGPTRLKDDKGQDVFVYRKKLEDLTGAMVEKIVDPVVKEIVKERLSEKGYAPEKKSTKLPKDIWQEPLYMKTTNSDKKVPIKKVRIRDVFNNMIFLNDREGKPYRAVAPGNNHHIEIFEYTDKRGNIKREGKVITMFEAVQRSQQGEPIVKRDYSDGKKFVCSLAINEMFMLEMDNGLEELYRVQKISQNGQIYLRPHTYAGDLKKQKGISKLPNKLKGHKVTVDMLGRVHMAND

SEQ ID NO: 8698 - protein, 993 aa, unidentified
  REGION 1..993: note = Description of Unknown:uncultivated organism sequence
MGSYTLGLDIGSHSIGWAILDTDKKPSILDIGVRVFPEGVDREKGQEKSKNATRREARGARRVHQRRSLRRDQIITTLKSAGLLPKDNKELNEFLNEKNPYELRKKGLDEKLDLYEFGRVLFHINQRRGFKSNRKTGSLKEEGQIAKSAGELQSVIEEQGYRTLGEYFAGLDPEEQRIREQYTFRSMYEHEFDLLWAKQSEYYLQGLTDELRKKIRDEIIFFQRPMKWDPDTIGDCQLEDGEKRCPRGDWYAIRFRILQDVNNLKICNPDGTIETLIPEQRKIILDELNKKREVRFTTIRKKLGLLETQKFNWEYEINERGKKREKLKGDEFTAAMRSRNIFGAKRWDALDNQQKIEINKVCLELENDELLEKMIVDYGLSEEQAEKAVKISLPRGYMSFSRKAIQKLLPLMEDGMRTDEALNKVYPERNRDKEAGEADKLGMPEDLRNPLVNRALFEVRKVVNAIFREYGKPKNIKIEMARDVRGNARQRKEIHFKMLDNKKRNEQTRKRLMEDMGIANPSRDDVIKYNLWIECGKVCPYTGKAISQEALFGPNPEFQIEHILPYDLILDDSYMNKTLCEVHENIHVKKNQTPYETYSSNPEKFEQLNQRINKTAMPYWKKQKFWQKEIDTGKIIIRELNDTRYINREVVKYLKQICSNVSGTRGKTTSELGYQWGFVKDRDDHRHHAIDAAVIAVTGPEHLRQLGKSKYSDGTISFQPPWPHFREELAEKVKHINVSHKPRRKVSGALHEETNYGPTGLKDEKGQEYFVYRKKLEDLTVPMVSKIVDDTVKGIVKSRLAEFGIDPDKKVKERNISKDIWTTKPLYMKTKKSKKKIPIIKVRIMEVLGNTEGIKDKDGKTYRYVKPGSNHHVEIWEYTEGEKKGKRESVVVTMFEAVRRSCNGEPVVQRNRGLGTRFVCSLAINDMVMMKNKAGEMDLYRIQKMDANKIVRFRHHTAAKIDKKETYIDKTAHLFDGYKVTLDPLGRIYAAND

SEQ ID NO: 8699 - protein, 996 aa, unidentified
  REGION 1..996: note = Description of Unknown:uncultivated organism sequence
MCTLGLDIGSNSVGWAILDPGASKVIDAGVRIFQEGVDRDTKGAEVSKNANRRAARSARRNRNRRNYRKDKLLRLLIRNHLLPQNTQELQQVFTKDPYFLRAKGLDEQLEPYELGRVLYHLNQRRGFWSNRRSEKKKDEGVVTKSVTALQQQVTQTGCRTLGEYFSQVNPHENPIRGCYTFRSMYEDEFERLWQVQSSYYQAILTEPLKKEIKDRTIFYQRPLKPSEDLIGECELEPGEKRCPKADWYARQFRILQTLNNLKIQNPDGTESVLTDEQRKVVLEELLNNKNVKFDALRNKLGLLETQTFNLEEGPRGKKKETLQGDEFNAHLRKVLGKKGFARLSQTDMIEINELLLDDSLSDGEAAEQLMERYGFSEEEAESVLASPLPQKYMSFSRLAIQKLLPFLEKGRLTHEAIRTVYGDSQARKPLQELDRLPFPEDLRNPIVNRALWEVRKVVNALLRVYGKPRKIQIEMARGLKGSAREREEIQFQQRRNEEENKKAQEELVRMGILSPSRDDIIKYKLWQECGQVCPYTGRPISQSALFGPHPEFQVEHILPYSRTLDDSYMNKTLCAVDENRRKGDKTPYEFYHGTEQFEQILQRIAKLPYPKRRRFWQEEVELDTFIRRQLNDTRYISRKVAEYLKNLGCIVQGTRGQITAELRHQWGLNSILDDSGLVEKNRDDLRHHAIDAAVTAVTENIHLRELARSKYTPAGQAAVRFAPPWENFRQQLKEIVNQINVSHRVCRKVSGPLHEETSYGPTGLKDEKGQDIYVYRKPLEALTLAMVLKIADPVVRQIISERLAAFGLSPGGKGTIPKEVWKEPLYMKTKSGRPGPQIKSVRIRDVFNNLIPIKDKEGKPYRYVAPGSNHHIEIFEYTDRKGRLKQEGRVITMFEAVQRSRNKQPVICRDYGDGKRFVCSLAINESFMLEVEDGGLVLHRVQKLDQNGRIILRPHTFGGKLKDNDSPPLIQRKSPNTLRGYKVTVDPIGRIFPAKD

SEQ ID NO: 8700 - protein, 645 aa, unidentified
  REGION 1..645: note = Description of Unknown:uncultivated organism sequence
MLDDTLQDEEVAEKLMEHWGFGQEQAQKILEVSLPQKYMSFSRLAIQKLLPHMERGLLTHQAIEAVYGSSHGRQAVEVLESLPFPEDLRNPIVNRALWEVRKVVNALIRVYGKPQKIKIEMARELKGSKREREELQYRQRQNEEENKKAREELIRMGILNPSRDDIIKYKLWQECGQVCPYTGRPISQNALFGPHPEFQVEHILPYSRSLDDSFMNKTLCAVDENRRKSGRTPYEFYGETEQFEQILHRIAVLPYPKRRRFWQKEVELDKFIQRQLNDTRYISRKVCEYLKLLGCTVQGTRGQVTAELRHQWGLNSILDDTDLGEKKRDDLRHHAIDAAVVAVTENRHLRDLAHSKYTPAGQAAARFAPPWEDFRQQMQQIINQINVSHRVTRKVSGPLHEETSYGPTGLKDDKGQDIYVYRKSLEALTLSMVPKIVDPVVRQLVAERLEQFGLKPGGDGKITKEVWKEPLRMKTKSGAPGPQIKSVRIRDVFNNLIPIKDKNGKPYRYVAPGSNHHIEIFEYTDSKGRTKREGRVISMFEAVQRSRRKEPVVCRDYGDGGRFICSLSRNESFMLEMDDGTHVLHRVQYISILPGGPRIVLRPAAFGGQLSEKHKAPLIQRKMPNSLKGYKVAVDPIGRIFPAKD

SEQ ID NO: 8701 - protein, 995 aa, unidentified
  REGION 1..995: note = Description of Unknown:uncultivated organism sequence
MATVLGLDIGSNSIGWALLDNEEEKIVDAGVRVFQEGVNRDTKGSEISKHAARRAARSARRTRNRRNYRKDKLFRLLVRNGLLPQSKTELQNIFNMDPYLLRAKGLDEKLAPYEFGRVLYHLNQRRGFLSNRKSGKSKEDGVVVKSASAIQQAMLQEQVRTLGEYFSKQNPHEQRIRGHYTFRAMYEDEFEQLWQKQAAYNGHLLNDVLKKAIKDETIFYQRPLRWDPDTISNCQLEPNQKCCPRADWHARRFRILQTVNNLKINNPDGTQAELTEPQREILLKELYSRNEVPINSALKQKLRLLERQLFNVEEKAIADKEVKLKGDEFAAQLKKILGKKDFEKLEDADLIEINDALIDDSIDDADLISRLMDQYGFTEEQAKAVVNISLPQKYAAFSRLAIQKLLPHLEKGLLTHEAIEAVYGQPQAPKDIKVADRLGFPEDLRNPIVNKALWEVRKVVNALIREYGKPDSIVIEMAREVKGSQRERDEIRLQQWKQEQENKRAEEELKKIGIHKPSRDDIIKYKLWEECGHVCPYTGKPISQTALFGDHPEFQVEHILPYSRTLDDSYMNKTLCWVHENINKGDQTPYEYYAEKYPEQFEAILQRIAVLPYPKRRKFWQKEVELDKFIERQLNDTRYINRKVVEYLKTLGVAVRGSKGQITAELRHQWGLDSILNSELPGLKNRQDHRHHAVDAAVTAVVNQKHLHALAQSKYKRNDAAFAPPWESFRSDLEDRVNRINVSHEVTRKVSGQLHEETNYGLTGLKDDKGQDIYVYRKPLDALTPPMVGKIVDPVVRSIIQARLDEFGIRPGGKGTIPKEVWKEPVYMKSRSGVKVPIKKVRIRDVFNNMIILKDKEGKPYRAVAPGNNHHIEIFEYTDKKGNIKRDGIVVSMFEAVHRSRAGKPVVCRDYGDGRKFVCSLAKNEMFMLEVDGEYILHRVQKIIQDGRIVLRPHTFAGQVSDSDNPPFVQRKNYNTLQGYKVFVDPLGRIFPAKD

SEQ ID NO: 8702 - protein, 999 aa, unidentified
  REGION 1..999: note = Description of Unknown:uncultivated organism sequence
MYTLGLDIGSNSIGWAILNPEEKKVINAGVRVFQEGVDRDTKGAEVSKNAARRAARSARRTRKRRNYRKDKLFRLLVRNGLLPQDPLQQQALFQKDPYYLRAKGLDEQLEPYEIGRVLYHLSQRRGFWSNRKSEKKKEEGVVIKGAAALQKQIEESDCRTLGEYFARQNPHENRIRGHYTFRSMYEDEFEKIWQTQSGFYQDVLTDSLKEEIKDRTIFYQRPLKPTEELIGDCELEPGEKRCPRADWFARRFRILQTLNNLEIHNPDGTETKLNEDQRKIVLQELLSSKEVKFDTLRKKLNLLETQTFNAEEGPKDKKKESIQGDEFNAHLRKVLGKKTFERLAEQDIIEINDLLLDDTLQDEEVAEKLMEHWGFGQEQAQKILEVSLPQKYMSFSRLAIQKLLPHMERGLLTHQAIEAVYGSSHGRQAVEVLESLPFPEDLRNPIVNRALWEVRKVVNALIRVYGKPQKIKIEMARELKGSKREREELQYRQRQNEEENKKAREELIRMGILNPSRDDIIKYKLWQECGQVCPYTGRPISQNALFGPHPEFQVEHILPYSRSLDDSFMNKTLCAVDENRRKSGRTPYEFYGETEQFEQILHRIAVLPYPKRRRFWQKEVELDKFIQRQLNDTRYISRKVCEYLKLLGCTVQGTRGQVTAELRHQWGLNSILDDTDLGEKKRDDLRHHAIDAAVVAVTENRHLRDLAHSKYTPAGQAAARFAPPWEDFRQQMQQIINQINVSHRVTRKVSGPLHEETSYGPTGLKDDKGQDIYVYRKSLEALTLSMVPKIVDPVVRQLVAERLEQFGLKPGGDGKITKEVWKEPLRMKTKSGAPGPQIKSVRIRDVFNNLIPIKDKNGKPYRYVAPGSNHHIEIFEYTDSKGRTKREGRVISMFEAVQRSRRKEPVVCRDYGDGGRFICSLSRNESFMLEMDDGTHVLHRVQYISILPGGPRIVLRPAAFGGQLSEKHKAPLIQRKMPNSLKGYKVAVDPIGRIFPAKD

SEQ ID NO: 8703 - protein, 996 aa, unidentified
  REGION 1..996: note = Description of Unknown:uncultivated organism sequence
MYTLGLDIGSNSVGWAVLNPEKELVINAGVRVFQEGVDRDTKGAEVSKNAARRAARSARRTRKRRNYRKDKLFRLLVRSGLLPQNPAEQQILFQKDPYYLRAKGLDEKLEPYEIGRVLYHFSQRRGFWSNRKSEKKKEEGIVAKSASELQKQIVESGCRTLGEFFAKLNPHEQRIRGRYTFRAMYEDEFEKVWQTQSCYYQAVLTDTLKTEIKDRTIFYQRPLKPSDELIGNCELEPNEKRCPKADWYARRFRILQTLNNLEIHNPDGTDVKLNETQRQIVLQELLSSEKVKFDTLRKKLGLLETQTFNLEEGPKDQKKESIQGDEFNAHLRKSLGKKLFEQLAEQDLIEINDLLLDDALQDEEVVEKLMERYGFTQEQAQKILEVPLPQKYMSFSRLAVRKLLPHMEKGLLTHEAIQAVYGSPQGRRPVQTADQLPFPEDLRNPIVNRALWEVRKVVNALVRVYGKPQKIKLEMARELKGTKREREEIQLRQRQNEEENKKAREELMRMGILSPSRDDIIKYKLWQECGQVCPYTGRPISQNALFGPHPEFQVEHILPYSRTLDDSFMNKTLCAVDENRRKGDRTPYEFYGETEQFEQILHRIAKLPYPKRRRFWQKEVELDNFIQRQLNDTRYISRKAEEYLRVLGCTVQGTRGQVTAELRHQWGLNSILDDSELGEKKRDDLRHHAIDAAVVAVTENRHLRDLARSRYVPAGQAAVRFAPPWEGFRQQLQEVVSRINVSHRVTRKVSGPLHEETSYGPTGLKDDKGQDIYVYRKPLDGLTLAMVPKIVDPVVRQIVVERLEQFGLKPGGDGKITKEVWKEPLRMKTKSGQPGPQIRSVRIRDVFNNLIPIKDKDGRPYRYVAPGSNHHIEIFEYTDAKGRTKRQGRVVSMFEAVQRSRRKEPVICRDYGDGGKFVCSLSRNESFMLELDDGKHVLHRVQKIDQNERIILRPHTFGGKLQDSDKPPLIQRKSPNTLNGYKVTVDPIGRIFPAKD

SEQ ID NO: 8704 - protein, 996 aa, unidentified
  REGION 1..996: note = Description of Unknown:uncultivated organism sequence
MYTLGLDIGSNSVGWAILDPDASKVIDAGVRIFQEGVDRDTKGAEVSKNANRRAARSARRNRNRRNYRKDKLLRLLIRNHLLPQNTQELQQVFTKDPYFLRAKGLDEQLEPYELGRVLYHLNQRRGFWSNRRSEKKKDEGVVTKSATALQQQVTQTGCRTLGEYFSQVNPHENPIRGCYTFRSMYEDEFERLWQVQSSYYQAILTEPLKKEIKDRTIFHQRPLKPSEDLIGECELEPGEKRCPKADWYARQFRILQTLNNLKIQNPDGTESVLTDEQRKVVLEELLNNKNVKFDALRNKLGLLETQTFNLEEGPRGKKKETLQGDEFNAHLRKVLGKKGFARLSQTDMIEINELLLDDSLSDGEAAEQLMKRYGFSEEEAESVLASPLPQKYMSFSRLAIQRLLPFLEEGRLTHEAIQAVYGDSQARKPLQELDRLPFSEDLRNPIVNRALWEVRKVVNALLRVYGKPRKIQIEMARGLKGSAREREEIQFQQRRNEEENKKAQEELVRMGILSPSRDDIIKYKLWQECGQVCPYTGRPISQSALFGPHPEFQVEHILPYSRTLDDSYMNKTLCAVDENRRKGDKTPYEFYHGTEQFEQILQRIAKLPYPKRRRFWQEEVELDTFIRRQLNDTRYISRKVAEYLKNLGCIVQGTRGQITAELRHQWGLNSILDDSGLAGKNRDDLRHHAIDAAVTAVTENIHLRELARSKYTPAGQAAVHFAPPWENFRQQLKEIVNQINVSHRVCRKVSGPLHEETSYGPTGLKDEKGQDIYVYRKPLEALTLAMVLKIADPVVRQIISERLAAFGLSPGGKGTIPKEVWKEPLYMKTKSGRPGPQIKSVRIRDVFNNLIPIKDKEGKPYRYVAPGSNHHIEIFEYTDRKGRLKQEGRVITMFEAVQRSRNKQPVICRDYGDGKRFVCSLAINESFMLEVEEGSFVLHRVQKLDQNGRIILRPHTFGGKLEDSDSPPLIQRKSPNTLRGYKVTVDPIGRIFPAKD

SEQ ID NO: 8705 - protein, 1012 aa, unidentified
  REGION 1..1012: note = Description of Unknown:uncultivated organism sequence
MAKILGLDLGSNSIGWALLESKTESGNDFSRIIDAGVRIFQEGVDRSTTGAELSKNAQRRAARGARKLHKRRNQRRESLQALLIDRDLLPDSQEDFDTLMQVNPYQLRAKGLNEQLSFYELGRVLYHINQRRGFKSNRKAGKSDGKVATALSVLQQQIDEQKYRSLGEYLASIEPREQRIRCRYTKRSMYEDEFELIWNKQSTFYSDSLNSELKREVQNIIFYQRPLKVQKFLIGLCEFEKKEIINQKGEKQWSGKRRSPKGTWYAQQFRMLSEINNLIVIDGNDEWQLSDDLDLRDKLVHALQQKKTMNFSAIRKLLFSKGDQAWDHIRFNLEEGGRDKLQGNAAEYSLRSVLKKKYDALSVEQRDALIHDLLFLEDEKILRHHCELLGFSDEVIAKLMKMKFEDSYFHLSQKAIKKLLPHLEQGLKYSDAVEAAGYKRRDQADNTVIAQLAEPPQLKNPIVQKALYEVRKVVNAIVREYGKPAKIRIEMARNLKASAKQRKEASFHNAKNRRRNEEIRTRLGKEYGISNPSRDDVIKYRLWEECNHTCPYTNQTISAAMLFSPEVEIEHILPYSRSLDDSYINKTLCLSSENKIKGNQTPYEAYHTDDDRFHTMLARVRKFSGAFGYKKFNKFRQKEIRLDSFIERQLNDTRYISREVSSYLEQLVGNNHVQSGRGQMTATLRRLWGLNGILHDSGEKTREDHRHHAIDAVVTALSTPKALKEVSAASKYGRLDKLSIERFPMPWDGFRHDIGAQVKSITISHRVMRKIRGALHEETAYGSLKLTNEKNTEMYAVRKSVSELSHKEVTQIGDERIRSSICSYIIAKGFDPKDSTDVKKALKDAETNPPVMASGQPIKRVRLHKPFSNIRMLKNKKNKEYRGVLEGSNHHIVIYEYEDKRDITKRGGIVVSMFDAAERARHGKAVIQRNLEDGKRFVMSLSINELVEVPIGEDESEVYRVQKMNAATQICLRKHTAANINDHSSRMLVMPNTFNGKKVVVDPLGKIYPAND

SEQ ID NO: 8706 - protein, 1050 aa, unidentified
  REGION 1..1050: note = Description of Unknown:uncultivated organism sequence
MKNYRLGIDLGATSLGWSLFELDNNNEPVKLMRVGVRIFPDGRKAAGKWSKKEPLNVTRRTARGIRRNRDRYLQRRNDLMKYLIENNLMPKDISERKELEHLDPYYLRAKGLDEQLTLFEFGRAIFHLNQRRGFKSNRKFDSADKETSIMKMAIKELAEKLEETDSRTLGEYLYNLNKDLPKKEIVHSKPRRVKKGDKSYNLFPDRAMYLDEFEQLWEKQHEFHSELTNEIKTNIKNIIFYQRDLKPQEKGSCQFEEGEFRCSFAYVTAQKFRIFQELNNLELLDFNKKNHKLTDEQRAIILHTLLTQKTATFKSLRRKLGKDFANNFTFNLESEKRKDLKGDETSAIMRKDNYFGDKWDELADTEKDEIVTKILNEENDKEVETNLVNWLCDKYSLSEENAQNIANASLSKKISNLSGKAIRKLLPFLQDGFIYSDACEKAGYKLTDEAPEKPKFYKGNLPYYGELFEKDALFGDKEKYNSENEPEKYYGKIPNVTVHIALNQLRKFINELSKTYGAPKQIVLELARELKLGRSKVAEIEKIQAKNRKYNEKIAVELEKISVENNYANRTKYKLWEELADDPTKRCCPFSGIQIPIHKLFTHEFQIEHILPKSKTFNDRMVNKTIAHRKANQDKGERSPFEAFGHNPTGYNYNEILLRAEQLPFAKRRRFFPDAMKNYEDEGEVLSRMLTDTQYMSRIARKYMAFVCGKNNVWSIPGQLTAKLRSKWGLNELLSEDSSKNRADHRHHAVDAFVVACTSRSTMQKVARAIGNSRDKFIDKMPPPFKQFKHKEMKQLLDDMVISFKPDHGNAKKAITEHKTVGQLHKETAYGLVSKDEEKGKIILSVRKELVSLESIKKIKEITDPRIRATLLQLTEGKTGKEITGIISEFSKETGIKRVKTQIEKSLNSVVRIEDNKGNYKYYELRNNYCADIYCPDKGKKAGKWQIEIIPMFYAHQTNFIPDWQKANPTAKKIMRLYINDTVAYEENGETVIRRVKKMNIDGRLFFIDHKIAKSDKDPNATSVKQLQEKDGRKVGVDILGRVSDPKRAK

SEQ ID NO: 8707 - protein, 1118 aa, unidentified
  REGION 1..1118: note = Description of Unknown:uncultivated organism sequence
MKNILSLDLGITSVGYSILKQLDTDKYSLVDYGVSMFDKPYDEKNNSKKILHSEVTSFKKLNDLKKERKRNLALLFEEFGLGDKDYFLYQEKQNVYKNKWHIRAKKAFCERLKVEELFTILYSIAKRRGYKSLETSDLLEELCKELEIPFEEDKKTKNNEEKGKIKSALKRVEELKERYPQKTVAAIIYEEELKNPTPVFRNHDNYRYMIRREDINDEIKKIVLAQKEFGLFDKDFDVDKFIKRLIKTIDDQKESTNNKDLLANCEFYKEHKVAHQYSLITDIFKMYQAVSNITFNSKPEIKITKEQIKLIADDFFKKVRKGKKIDSIKFKDVRKILNLPDDIKIFNKEDFSVKNGKKQDNYIIKFHFVNNLSKIDNTFILKAFEKENPYEELKEIFDTLGFEKSPKIIYENLKNKIDNKTIVELIKNKTGSSTRISSYAMVKFIPYFEQGYTLDDIKKELGLIRNEDYSKFQKGIKYLSVSQFENDDSLLINNHPVKSIVSAALRVTKHLHVKHGPFDEIKVESARELSQNEETRKAIDKANKELEKQIDNIMENEEYQEIAQRYGRNLRKYARKILMWLEQDKLDIYTGKNIGISEIFSNTVDIDHIVPQSLGGLSVKHNLVLTHKDSNLKKSNQLPINFVEDKNAFENRVEHLFRERKINWKKKVNLLATTFDETFKDTFESKELRATSYVEALTAQVLKRYYPFPNEKKQKDGSAVRHIQGRATSNIRKLLHVKTKVRDTNIHHAVDAILIGLTNQSWLQKLSNTFRENFGKIDDEARANIKKATPLIDGIEPSELIGMIEKGYNKFGKESVFYEDIWGKTKTVYFWVSKKPMVSKIHKDTIYAKKENGIYTVREKIIDKFVSLKVSSKTKVDEFYKKFKKEILYKMYLHEINQNDVIYKTVQKRGDEIAEMLKSFERLDANDKEALAEAKDELNNLIHKPLIDNNGNEIRRVQFYQTNLTGFEIRGGLATKAKTFIGFKAKLKDGKFKYERIDMSNIQRIKKKKDTGFKVYKNDVVFFTYPDGSCKGGRIVSFLDEKNLVAFSNPRFPGSIAYQPEEFLTFFNGKPNSHKQHSIKKAIGIIKLNLDITGNIKSYRTIGSCESEFLEFLKSIKS

SEQ ID NO: 8708 - protein, 1118 aa, unidentified
  REGION 1..1118: note = Description of Unknown:uncultivated organism sequence
MRKILSLDLGVTSCGYAVMEDIGANSYSLLDYGVVMRDNLNDRGTQKDRREKKQSRELLDKKKKRVQQIKQLFEEYSLSYQDKKHYDIWKLRAVDAFERQLSNDELFALLRFVAKHRGYKSLKIEDLIAEIEAKEKIGDCESGEINVPTDLEKFSETLAYLDALKCQHKDKTAAQIIWELESQKENSTFRNHGNYRYMVRREDIKKEIEKLIEVQQAFGFFKNEQDAKEFASKVTEIVIPQEAVTLNPDNINKCLIYKEEICAPLFSYSFDMFQVYKLLADLKIGGVNASVEQKEQILQKLLEDMKKFKCKNIYSVKDFKKILEINDEDVKINNFQEFKTVKGKKEPNNLIKFHFISSFKKLDLAILNEIIKDEKHDEIFDAIATQIHLNVNPEKLLENIQELFQRYDFSFSKEAIRDFTLALHKNKVSGTSSYSLKGLKDLISLMKDGKNESDAKEMLGVSKSENYSQFLKGIAYLKPQNKEGQLRYEIDENKISNHVVKSLVNWALRVVVDLHAKHGTFDIIKLESTRELSQPDDVKRDIKAANDKNEKEWQGLIQKYKKHFEAKGLNLQNNKEYLLKLKLWEQQKEFGIYSYKVLSIDEVLSDKTEIEHIVPRACGGSNAEYNKALDIKDENAKKGNKLPLDYLSGEKKEVYINFVKELKESHTINFKKFKNLMAEELKDVYKEARDDVSLHATSYTEKLLGEILKRYYPFSDLVKENQRVMHISGRATSYLCRILGIDNKSRDTNFHHAEDAILLGVMSRSYLQNISTNFEKNYELTSQNAKENFKKIIPMIEGASPHQIFTHIRESYMEDIENSPFYKALDGTLKTPAFWVSKKPIGTKAHNETIQSKKNMAYYVPVNSLLDRVKPNHKMGTDEFYKKFNKEVYEKIQVVQDNPKDFTSLAFAKKRDEVVTLLNKTAFVSTKDEKAELDKELRNLMAKPLYDVNGNEIRRVKRVGEKVSIRVRKGYAGNAPSMLAMRCSVETPTRLFTDRIDFKDSILLKKNDGSCIDIFNNDLVEICTYEKKQVVLKLTGLLRTFVIDAKENKMLKVKNPKYPIREEAQPKQYNSYVAVKKMCGIKKYKTDASGKVLGFYYLGRVLDNEKELFAKVLSYKAL

SEQ ID NO: 8709 - protein, 1137 aa, unidentified
  REGION 1..1137: note = Description of Unknown:uncultivated organism sequence
MKRILAVDLGITSFGYAILEELEENRYKCIDFSVIMRDSPYNEKGKSKQSLRSSFASLRNLIKKRKKRIKNLAKLFEKYNLLTYQNAMLIQKENKIKNKWQIRANKALNEKLSNEELFAIFAHMAKHRGYKSIATEDLLYELQLELKLITNDTSESQLDDEKKQIYAALNKIEKLKEQYKTQTIAQLIDKAVKEGKLKSFRNHDNYEKMIRREDIEYEIQTIIKKQCDFKALNFNKEECSKFTNEILEIITKQDMPQNDESVFGKCSYYKNEKAAPKYSFLYDLYRLYKTLADLNITNYNLTKEDREKIVNYVKEKITNGKQLKQITYKDIRKILGLNSEQKIFNKEDTVILKGKETQRVFVKFFFISDISKFSNLIRQIIKQKNYIDIFKDIAEIIQLERTPKIAFKKTTELLNKENIKYENHEIIELIKAKKAGTLNLSHRFIKQALPYFIEGKNEKDIKEILGIANFEDYSNYPKGLKYLHLGKNNYFEQINNKINNHAIKSLASWALNNIADLSWKYGIFDEIIIESAKDVLPKKIQKAIEKFSNEQKKEIEKIIKSYKDQFPNINKNMAKKIKLLESQNFLDLYSGKTINISDLFEGKADLEHIVPKSLGGLNTDYNLVIAYKDTNMQKSNRLPLDWLNGNQQYINRVENLFKEGKINWKKRKNLLANSLDEIYTEIKDTKSLRATSYLEALVAQVLKMHYPFKNKEHRKNAIAIRTIPGKTTSKARALLNIKSKSRDTNFHHAEDALILATLNRKWHNNLHRYLKDNYGKTEKELQKIWQKNTPYIEGISISDYLKDAFEKFMSKGENSIWYKDMFGCIRSVSYWVNKKPLSASSHKDTVYSAKHKDPNNPKKILPTVRKNILKEFENLKIVSKRGSLTAQEFLELYYKNIRQKLWLYKIGNFNDLTYKAIEQRAKNIADTITKYKKSSKTDKESDKRYLEELNKWLTTPITIDNKNIYKTIFIDDTFAPLKIKRGKNNEVIVRTDDNFLAVIFEKKDNNKLNITKVDINSLEKLESKNSLIVYLNEIIYIFNNKKIIHYGALRSFSISNQGAKLIKLFNPKFPSNPKAQPAYFSKGSSFKDISIGSATGVIKVKLDISGKIKSYQKYGFISKELEEQFLKESGYGCLENS

SEQ ID NO: 8710 - protein, 1127 aa, unidentified
  REGION 1..1127: note = Description of Unknown:uncultivated organism sequence
MKKILAVDLGITSFGYSILEEANDNSYRCIDNSVVMRKSPYEEKSGESSQKQHSAQKSLRKLNKKKKKRIKCVAKIFDDFGLLPYEKALQINRDNPIKNKWELRAIDALQRPLSPEELFAIFAHMAKHRGYKSIATDDLLYELERELGLRDSETAGSTKSDERSQVYAALNRLEELKKSYGSETIAQVIHRAVAEGKFRSYRNHDDYEKMIRREDIEEEIEKILLKQAELDALPLDNEQIGELIDRLKECITDQKPPTIDESLFGYCTFYKEEIAAPRYSYLYDLYRLYKKLADLSIDNYEVTPEDREKIIRWVEEKIKAGKNVKSISYKEIRKILGLSPDQKIFGQDDERIIKGKKEPRVFVPFFFLANISKFKNLIASIQKHPDAQQIFKELAEILQRSKTPRESYEKIQELLQGKGINASEAEIVELFKNKKPGTWELSHKYILQALPLFLEGMKEADIKKQLGFSDSEDYSAYPKSLRHLHLREGNLFEKDTNPINNHAIKSLASWALGLIADLSWRYGPFDEIVVESARDALPENTRKDIDKAMAEREKSLETIVKKYKSQFPTIDKRLARKIQLWEQQKELDLYTGQTIKLTDLLDGRADIEHIVPRSLGGLSAEYNTIVALKDANAQKGNRLPGDWLSHDDAYKQRIEMLKNKSLINWKKYKNLTATSLDETYTETFHSKGLRATSYLEALVAQVLKRYYPFPDPKARRHGHTVRMIPGRVTSKTRSLLGIKSKSRDTNFHHAEDALILAIINRGWQNRLHRMLRENYGKSEAELKALWEKYLPHIEGLTVPDYVKEAFERFMSKGEESLFYRDMFGGIRSVSYWVNKKPLSASSHKDTVYSPRHDIPTLRKNILDTFASLDVLKKRHDLTADEFMKKYDTEIRQKLWLHRIGNVNDESYRTVEARAAQIAETITRYQLMDAQNDKTIDEEYQQELKTLLSTPIEVGGKQLRKMRFVYDKLNAVQIDRGLVETDKNMLGIHLSKGPKGKLTIRRVDVNNAHQLSRQKEGMLCYLNEMLFFFNKDKLIHYGCLRSYIESSKKVALFNPRFPANPKTQPKRFTTGSQIKQVSVGSTTGVIKAHLDLDGHVKSYELFGQITPKQLRWFIEESGYGGVENDPDH

SEQ ID NO: 8711 - protein, 1141 aa, unidentified
  REGION 1..1141: note = Description of Unknown:uncultivated organism sequence
MKKILSLDLGITSLGYGILNEKENNIYECIDHGVMMRDAPFDSKGNSKQSLWRDYASQRSLNIKKKRRIRQLASLFETYGLCSFDACMKVQYKNKITNKWKLRAEDALNRKLTYEELFAILAHMAKHRGYKSIATDDLLYELEVELGLIDDEMNVKDSDDEKRQVYAALKRLEKLKAEYKQETIAQVIHRAVEKGKFRSYRNHDNYEKMIRREDIEDEIETIIAKQCAFSAFDIGSDQCITFTERIKEIITDQVMPENDPSLFGNCAFYENEKAAPKYSYLYDLYKLYKTLADLKINGKPATKEDRKKIVSFLFGKVSKGKNIKELKYKEIRKVLNLSTDQKIFDKEDTMTIKGKKSDRTLVKFSFLSEIGKFPQLVTDIAEHPQYMEIFAQLAEVLRLHKTPQEAFKAIKLLCKSHTIEVVEREVLELIKSKNAGTLSVSHKFIMDVLPYFKDGYSESEAKEQLGVKTSEDYSTFSKSLKHLHLGKNNLFEKIQNKINNHAVKSLASWILRRITDLSWRYGIFDEIVIESARDTLPKSIRDAIDKSMREREKEVDKIVDQYKKEFPNIDRKMARKIKMLESQKFIDLYTGNIINISDLFEGRADIEHIVPRSLGGINADYNIVISHRDSNMQKSNRLPMDWLAENVDYINRVEKLFSDHLISWKKRKNLLARSLDETYVEVRDTKALRATSYLEALIAEVLKMHYPFPDVEHRKNGIAVRNIPGKTTSKTRSILGIKSKSRDTNFHHVEDALILATISRGWQNRLHKMLRNNYGKSEEELKKLWKAYTPHIEGITIADYVKEAYERFMSKGEESPFYHDMFGDVRSVSYWVNKKPLSASSHKDTIYSAKHKDPNDPSKTVPTIRKSILSAFASIKIVENRNRWSLDDFEKVYDKEIRQKLWLYRIGNINDPVYRAIEGRAQVFKDIINEYIYKDVGNNKEEDEIYKQKLNAFLNEPIVAANKPVYKVHFVDETFNSIVINRGKGNEVLVRTDDNFLAMIFAKGEKEKLHIEKVDVNSHKKLQNKDAMIIYLNEMIYLFNKKKIIHYGCLRSFSVKSAGGKYVKLFNPRFPSNPKAQPKKFSTGTSTRDVSVGSVTGVIKVHLDLTGKIKSYEKFGLISKELEERFLEECGYGSMEDDTYH

SEQ ID NO: 8712 - protein, 1129 aa, unidentified
  REGION 1..1129: note = Description of Unknown:uncultivated organism sequence
MKKILAVDLGITSFGYSILEEANDNSYRCIDNSVVMRDSPYDEKGESSQKQHSTQKSLRKLNEKKKKRIKCVAKIFDDFGLLPYEKALQINRDNPIKNKWELRAIDALQRPLSPEELFAIFAHMAKHRGYKSIATDDLLYELERELGLRDSETAGSTKSDERSQVYAALNRLEELKKSYGSETIAQVIHRAVAEGKFRSYRNHDDYEKMIRREDIEEEIEKILLKQAELDALPLDNEQIGELIDRLKECITDQKPPTIDESLFGYCTFYKEEIAAPRYSYLYDLYRLYKKLADLSIDNYEVTPEDREKIIRWVEEKIKAGKNVKSITYKEIRKILGLSPDQKIFGQDDERIIKGKKEPRVFVPFFFLANISKFKNLIASIQKHPDAQQIFKELAEILQRSKTPQESYEKIQELLQSKGINASEAEIVELFKNKKPGTLELSHKYILQALPLFLEGMDEKEIQRQLGFSDSEDYSAYPKSLRHLHLREGNLFEKDTNPINNHAIKSLASWALGLIADLSWRYGPFDEIVVESARDALPENTRKDIDKAMAEREKSLETIVKKYKSQFPTIDKRLARKIQLWEQQKELDLYTGQTIKLTDLLDGRADIEHIVPRSLGGLSTEYNTIVALKDANAQKGNRLPGDWLSHDDAYKQRIEMLKNKGLINWKKYKNLTATSLDETYTETFHSKGLRATSYLEALVAQVLKRYYPFPDPKAQQHGHTVRMIPGRVTSKTRSLLGIKSKSRDTNFHHAEDALILAIINRGWQNRLHRMLRENYGKSEAELKALWEKYLPHIEGLTVPDYVKEAFERFMSKGEESLFYRDMFGGIRSVSYWVNKKPLSASSHKDTVYSPRHDVPTLRKNILDAFAALDVLKKRHDLTADEFMKKYDTEIRQKLWLHRIGNVNDESYRAVEARAAQIAETITRYQLMDAQNDKTIDEEYQQELKTLLSTPIEVGGKQLRKMRFVYDKLNAVQIDRGLVETDKNMLGIHLSKGPKGKLTIRRVDVNNAHQLSRQKEGMLCYLNEMLFFFNNKKLIHYGCLRSFSINNQGAKYLALFNPRYPANPKAQPKRFTTGKKIKPVSVGSTTGVIKAHLDLDGHVKSYELFGQIIPEQLRWFIEESGYGGVENDPDH

SEQ ID NO: 8713 - protein, 1148 aa, unidentified
  REGION 1..1148: note = Description of Unknown:uncultivated organism sequence
MNGKRRKRILGVDLGVTSFGYGIVETEKGTSDYTVVDKGVVTRDRFVNDPKSGKTPQKKHSEIQSRSKILDAKKKRRYAVAEIMEKHGVLTVKECRESARKNTITNQWELRADDVWKRPLSPEELYAIFKHMADHRGYKSLSTEALILEEKRKAGVVDAKEETPKTATEEGDDAGFAMAAMELDALRKKYPGETVVVTIRKAIENGEHSSWRNHDNREKVIRREHIEEEIEKVVARQYEMGAFDFGEDAAIGFVKDMKEAIIHQDLPTIDISKFGTCPVYPEEICAPKFSYVSDMYRIRKHLADLRIDGNPLSKEERSAVTGWIEESAKKGSLPEKITYTKLRKILKLPEERLFNGMPDRIEGEKKDIPRVFVTLLYLPVLGKTPGLMRIETEHESPMDVHESIATALQLSLTPTEGVAKAAEALKKHGVSMETLELLELFAAKGKRSGTMNLSHRFMREALPLFEEGLDESGIREHLGISTKEEYGAYPKSVRHLHLGKGNHYERNFGVVNNHEVKTVASWSLGLIADLDRRYGPFDEIVVETARDALPPKRQKAIEIAQKRRDERISKTIEAHKKEIPGMDRRLAAKIILLEECGGIDIYTGRGIGLSDILDGRVEIEHVIPKSLGGSNADYNLVLAYRDTNTRKGNRLPGDIYGHDPAYKERVERIFAKNGKKKRNLLAETIDDAYIGVSDTASMRATSHIERVVTQVLKCHYPFPNPEHRENGVAVRMVPGKTTSRMRGLLGVKSKSRSTNFHHAEDALILATLDRGLFNRIHKNLRENYGKSKEELKKMWASLLPTIDGRPVREYLAEAAEKFHSKDKDPEGKNLFYRDMNGEIRTVSHFVRKKPGTGAAHGESVYSAKYFERFGQIIARKKLSEEIEKMGIAKKRHSIGADEIEKKFEELVAKTVLHLSGEPNHPVCVAIRERGKEIVELLEKYRQLGAKDDKELDEKFRKELGDLIASDIVAGGNPVRKIAIVPPGTGGAMGIRKRNGKPTGYVTKEKNAIGIFVEKSGKGIDVRRVDVTNKNEFAEKSKKGEGRIFYMNEPLFFFDKKGQIVASGALGGTTTIDKMGIAGKVMLFNPKFPRSPKFQPSHFATGKGSLKEFGIKKAVGVLKITPDLTGRIIKHEKIGIVPSDAMKIVLEGV

SEQ ID NO: 8714 - protein, 1129 aa, unidentified
  REGION 1..1129: note = Description of Unknown:uncultivated organism sequence
MKKILAVDLGITSFGYSILQETSRNSYQCLDNAVVMRSSPYDEKSGESSQKQRSSQKSLRNLNQKRKKRIKCVAKIFDHYGLIPYQKSLKINRDNPIKNKWDLRAITAWQRLLSPEELFAIFTHMAKHRGYKSIATDDLLYELEMELGLRNLETEDSKKSDERSQVYAALNRLEELKKSYGSETIAQVIHRAVAEGKFRSYRNHDDYEKMVRREDIEEEIEKIILKQAELGALPLDNKQIGGLIDDLKECITDQEMSTIDESLFGYCTFYKDEIAAPKYSYLYDLYRLYKKLADLKIDHYEVTPEDRNRIIQWIEEKIKAGKNIKSITHKEIRKILGLSPHQKIFGQEDERIIKGKKEPRVFVPFFFLANISKFKKIIASIQKHPDARQIFKELAEILQRSKTPRESYDKIEKLLQSKGIYASEAEIVELFRNKQPGTLELSHRYILQTLPLFLEGMDEKEIQRQLGFPDSEDYSGYPKSLRHLHLRDGNLFEQSVAPINNHAIKSLASWALGLIADLSWRFGPFDEIVVESARDTLPEKVRKEIDKAMREREKALEEIIKKYKDQFPTIDKRLARKIQLWERQKELDLYTGRTIKLSDLLDGSADIEHIVPRSLGGLSTEYNTIVSLKDANAKKGNRLPGDWLSNDDTYRRRIDMLKDKGLIDWKKHKNLVAASLDEIYKENMHSKGVRATSYLEALVAQVLKRYYPFPDPEARRHGHTVRMIPGRVTSKTRSFLGIKSKSRDTNFHHAEDALILAIIDRGWQNRLHRMLRENYGKSEEELKKLWERYSPHIEGLSIADYLKEAFERYMSKGEESLFYRDMFGGIRSVSYWIDKKPLSASSHKDTVYSARHSIPTLRKSIFDAFAALEVVKNRHKLTAESFMKLYGKEIRQKLWLNRIGNLNDESYRAVESRAAKIAETINRYQLMDAQNDKSMDDEYQRELKALLAAPIEVNGKQLRKMRFMINKNTIPINRGLVETDKNMLGIHLSKGPKGKLTIQRVDVNNAHKLKRQREGLFCYLNEMLFFFNEKKLIHSGCLRSFSINNQGSKYVKLFNPKFPSNPKAQPKKFSTGSSTRDVSVGSTTGVIKVHLDMDGHVKSYELFGTVTSEQLRWFIEESGYGGVENDTNH

SEQ ID NO: 8715 - protein, 1131 aa, unidentified
  REGION 1..1131: note = Description of Unknown:uncultivated organism sequence
MGKKILAVDLGITSFGYAVLEEKEENSYICLDNAVVMRDSPYNESGESTQHIRSLQRSQRRLNEKKKKRIRCVAKVFDRFGLLAYEKALLSNRENRIKKRWELRAVDAWQRKLESEELFAIFAHMAKHRGYKSIATEDLLYELEIELGLRAIDGESAAKGDERSQVYAALNRLEELKKEYGSETIAQVIHRAVAEGKFRSYRNHDDYEKMIRREDIEEEIEKIVLKQAELGAFSLPNEQIGALIDALKECITDQEMPTNDMSLFGSCTFYKDENAAPKYSYLYDIYRLYKKLADLRIDNYEVTLEDRKKIIEWVEEKIKAGKSIKQLTYKDIRKILGLSDDQKIFGQDDERLIKGKKEPRIFVPFFFLSSIAKFKKLMAAIQKHPDAHAIFKELAEIIQYAKTPQEAYKKIKELLQKSGIEASDAEIVELFKNKKPGTLSLSHRYILQALPYFLEGMEEKEVQRQLGLSDSEDYSRYPKSLKHLHLGHDNLFEDEKNIINNHAVKSLASWALGLIADLSWRYGPFDEIVLETARDALPKDTKRKIERAMKEREKALDEIIKKYQDQFPAIDRRLARKIQLWEQQKELDLYTGQTISLTDLKDGRADIEHIVPRSLGGLSAAYNIIVALKDSNVQKGNRLPGEWLAGDEGYRNRVEMLKDEGLIDWKKYKNLLATSLDEIFVEKMDSKGIRATSYLEALVAQVLKRYYPFPDPKASKHGHSVRMIPGRVTSKVRSLLDIKDKSRDTNFHHAEDALILATISRGWQNRLHRLLKENYGKSEEELQKLWQKHLPHIEGMTLADYIDEAYQRFMSKGEESLFYRDMFGGVRSVSYWVNKKPLSASSHKDTVYSPKHDVPTLRKSILEAFRALDVMKNRHKMSADEFMEKYDKEIRQKLWLHHIGNTKDAVYQAIEKRAKEIAKTFTDFALKDAKHDKSVDEAYLAELARLLNEPIVANGKSVRRVRFVYDKLNAISIDRGLVETDKNMLGIFIEKGAKKLQIYRMDVNNFREFSDKKGMVCFLNEMLFFFNSKKLIHYGCLRSFSINNQGAKLVKLFNPKFPSNPKAQPDKFSNGSSIRDVSIGSATGVIKAHLDFDGHVKSYEVFGSVSAEQLAWFRKESGYGSVEDGAHHEAL

SEQ ID NO: 8716 - protein, 1142 aa, unidentified
  REGION 1..1142: note = Description of Unknown:uncultivated organism sequence
MKRILAVDLGISSFGYAILEESGANRYRCIDNSVVMRDTPYDNDGNSKQSLRRSHSSMRSLNEKRKRRVRELARIFDSYGLLSYEECRRVRRENKIIDKWKLRAEDALSRPLSIEELYAILVHMAKHRGYKSIATDDLLYELELELGLTQEEPETLKDDEKRKVYTALKRLERLKERYEGETIAQIIHKAVLEGELRSYRNHDDYEKMIRREDIEEEIETIVKKQCEFGALPLDSGRCMEFIEALHATITSQTMPENDLELIGKCSYYPQEKAAPRYSYLYDIYRLYKTLADLNISNYEITAQDREKIIEFVTQKASKGKNIGQLLYKDIRKLLGLGDGQKIYGKDDRLKIGGKSVERTLVKFFFLKNISKFPSLMRKIISHTESLDIFGEIAETIRSHKTPRPAMDALKDILKRYEIEYDDMELIELIKGKSAGTLHISHRFIKDALPHFAEGKNEKEIKEILGVHICENYGDFPKSLKYLHLGKDNKFESENSQIPINNHAVKSLASWSLRLIADLSWRYGVFDEIIIESARDVLPKSIQDAIDKSMKKREKELDAIIGKYKNEFQSIDRKMARKIKLLESQNFMDLYSGGTIAISDLLEGRADIEHIVPRSLGGLSADYNLVIAHKDSNMQKSNRLPMDWLGGDKQYLNRVEMLFAEHKIDWKKRKNLLATSLDEIYSEVAHSKTLRATSYLESLVSEIIKMYYPFADEKSRIDGKAVRNVPGKTTSKTRSWLGIKSKSRKSNFHHAEDAMILATISRGWQQRLHTMLKENYGKSEDELKDIWKKFTPHIEGISLAEYIDEAYERFMSKGLESIWYRDMFGGIRSVSFRIDKKPLSGASHKETIYSSRHRDPENPDKILPTVRKSILDAFGALNILNNRHKWDREKFIKKYDKEIRQKLWLYRMGNLNDPVFRAIEKRAGEIGDLMESYIYKEPSHDKEIDERYQEELRELLQKPIVASGKAVYKVPFVDDSFSHIEINRGRGNRVIVRTDKNFLAVMFERGKKDRLEISKIDLNSMHRLRHSDAMIVYLNEIIYLFNKKKIMHYGALRSFSINKQGGKYIKLFNPRFPGSPKSQPGFFSTGSSIKAVSIGSATGVIKVHLDLDGRVKSYEKYGSIPKELERDFLEESGYGVMEDNTHH

SEQ ID NO: 8717 - protein, 1131 aa, unidentified
  REGION 1..1131: note = Description of Unknown:uncultivated organism sequence
MGKKILALDLGITSLGYAVLDEKVDNNYYCLDNSVIMRDAPYDIKSGESSQKKHGVYKRMRSLVEKRKKRINQVSKVFEQFGLLDFTSAKKIQTENSYKEKWKLRAEDALNRKLSHEELFAVMTHIAKHRGYKSIAMDDLLYELELELELVEPVGDEESLGDEKRQVYAALDRVERLKREFPHETIAQVIHRSVKEGKLTAYRNHDNYEKMIRREDIEHEIVTIIKKQIEYGLLDGRLDSEKFVEALKKAITEQVMPENDETLFGHCSFYPEERAAPRYSYLYDLYRLYKTLADVWIDHYELTQEDREKIVAYVENRIKHGKSIDKLTYKDVRKILALEDRCRIYGRSDEYLVKGKKTARVLMKFFFLSKIKTFAQMIRSIMDHTDAYSLFAAISEILQQEKTPKPAYNKIRSLLDAAGIEAEDKEIIALIKGYSSGTLSISHRYILDALPFFVQGKSEKEIQKILEVSLSEDYSKYPKSLKNLHLGEKNLFEEYRTSLNNHAVKSLASWVLRRVADLSWKYGVFDEIVIESARDTLPESIKKEIEKGLREKEKEIDKIVSTYKKEFPSIERKMARKIKLLESQNFTDIYTGKTINISDLFEGKADIEHILPRSLGGLSTDYNLVIAHRDSNMKKANRLPMDWLQGEKEYVNRVENLFHKHLINWKKRKNLLATSMDDVFMEIKDTKTLRATSYLEALVAENLKMFYPFPKKEHCKTGIAVRNIPGKTTSKARAILGIKSKSRDTNFHHAEDALILATLSRKWQNRLHRMLKENYGKSEDELKKIWQKYTPHIEGIEIATYVKEAFERFVSQGENSLWYKDMFGGVRSVSYWSNRKPLSASSHKETLFSGRHGIPTLRKSIYREFEGLNLVKERNKLTSESFMKEYEKEIRSKLWYSYSGNLNDPVMRAIDKKAAQIAGLIDHYVFQDAKNDKAMDERYKHELSELVLQPIVVDDKVVRKVRFVYAEYKSKVRPINRGLVENDKNMLGLFVEKGSKKLSFTRVDVNNVKELDRRFDGLKVYLNEMIYIFNDKKLIHYGCLRSFSENNQGTKYVKLFNPRFPSKPKSQPEKFAQPSGIKDVSIGSATGIIKVHLNLNGTVKSYEKFGTIPQKFEKEFLEESGYGGVEDNTHH

SEQ ID NO: 8718 - protein, 1127 aa, unidentified
  REGION 1..1127: note = Description of Unknown:uncultivated organism sequence
MYGGKKMGKKILSLDLGITSIGHSILDELDNDRYSLVDYGVSMFDKATDKDGKSKKLLHSASMSTANLYDLRKERTKNLAALFESYGLGKANDLLMQEKKNKFTQKWYLRAEKSFSEKLALEELFTVLYLMAKHRGYKSLDTDDLLEELLLDLEFEVPEKKEKDVEKGKIKQALKTVEALRKEYPEKTIARIIYEIEIKKSNPTFRNHDNYNYMIRREYIREEIEKIVLAQKDFGLFVNNMDTKAFIKELIVTIDDQKDSTNDLSLFGNCEYYPEHKIAHQYSLLSDIFKMYQSVANITLDKTKITKEQINVIAEEFFKKIKIGKNIAEIKYQDIRKILKLSDEVKIFGKEDYHLDKKGKKVHHTITKFHFLANLGKVDNSFIKSAFEKENKFEILKEIFDVLEFEKAPKSMYSKINEVFVKYALVEDERLKDETIISLIKYKSGSSLGTSAYAMIKFIPYFEKGMATDEIKQELKLERNEDYSGYRKGIKHLHVNTFEEDDNLEINNHPVKYVVSATMRLVKHLHVTYGAFDEIRVESTRELSQNEETKKAIDKANREQEAKFQKIIENEEYQKIARDYDKNLKRYARKIMLWEEQEKLDMYSGKVIGFDDIFSNRVDIDHIIPQSLGGLSVKHNLVLAHRDENVKKSNQLPMHFVADKTDYINRIEHLFKEYKINWKKKINLLAETLDDGYKDTFESKALRATSYIEALTAQILKRYYPFPDKKKQANGQAVAHVQGRATSNIRKLLGVKIKVRDTNIHHAIDAILIGLTNKSWLQKLSNTFRENMGVIDDEARAKIKKEIPLIEGIEPKELVELIEDAYNIYDEDSVFYKDIFGKTKTVNFWVSKKPMSSKIHKDTIYAKKQNGFFTVREDVIKQFIALKITTKTDSEAFMKSFEKSILHKMYSYKTNPKDAICSVVQHRASEIKSLLESFAGIDAKDKEIMSKAKEKLDALVHKELMDNNGNTIRKVKFFQSNLSGFDIRGGLATKEKIFIGFKAKFENEELIYQRIDLANMKNNLKIKGLFIGRNNLIYIVFKKEEKNLIGSLESFDEKNNTIRLFDPRFPKTLEYQPQKYKVTSGKSRKEFSIGSAMGIIKINLDILGNIKSYEKLGVITKELEQKLFHKE

SEQ ID NO: 8719 - protein, 1130 aa, unidentified
  REGION 1..1130: note = Description of Unknown:uncultivated organism sequence
MKKILAVDLGITSFGYSILQEVSHNSYHCLDNAVVMRDSPYDEKSGESSQKQRSSQKSLRNLNQKRKKRIKCVAKIFDHYGLIPYQNSLEINRDNPIKNKWDLRAITAWQRPLSPEELFAIFAHMAKHRGYKSIATDDLLYELEIELGLRNLEPEDSKKSDERSQVYAALNRLEELKKSYGSETIAQVIHRAVAEGKFHSYRNHNDYEKMVRREDIEEEIEKILLKQAELGALPLDSKQIGRLIDDLKECITDQEMPTIDESLFGYCTFYKDEIAAPKYSYLYDLYRLYKKLADLKIDHYEVTLEDREKIIHWVEEKIKAGKNIKSITHKEIRKILGLSPGQKIFGQEDERIIKGKKEPRVFVPFFFLANISKFKELIASIQKHPDAQQIFKELAEILQRSKTPQESYEKIKKLLQSKGIYTPEAEIVELFNNKKPGTLELSHRFILEALPLFLEGLKESEVKTQLGFSDSEDYSQYPKSLKHLHLGHGNLFEAEENPINNHAIKSLASWALGLIADLSWRFGPFDEIVVESARDTLPEKIRKEIDKAMREREKALDEIIAKYKKEFPSIDRRLARKIQLWERQKELDLYTGQTIKLSDLLDGRADIEHIVPRSLGGLSTEYNTIVSLKDTNAKKGNRLPGDWLSNDDAYRRRIDMLKEKGLIDWKKHKNLVAASLDEIYTENMHSKGIRATSYLEALVAQVLKRYYPFPDPEARRHGHAVRMIPGRVTSKTRSFLGIKSKSRDTNFHHAEDALILAIINRGWQNRLHRMLRENYGKSEEELKKLWEKHTPHIEGLSIADYLKEAFERYMSKGEESLFYRDMFGGIRSVSYWINKKPLSASSHKDTVYSARHSIPTLRKNILDAFTTMDVVKNRHKFTAESFMKLYDKEVRRRLWLHRIGNLNDESYRAVENRAAKIAETINRYQLMDAQNDKTIDDEYQQELKTLLAAPIEVNGRQLRKMRFVYDKLNAVQIDRGLVETDKNMLGIHLSKGAKGKLTIRRMDVNNVHELSRQKDGMLCYLNEMLFFFKPDKLIHHGCLRSFLENSQGAKLVALFNPKFPATPKSQPKFFAPGSQIKQVSVSSTTGVIKAHLYLDGHVKSYELFGTVTPEQLRWFIEESGYGGMENDTNH

SEQ ID NO: 8720 - protein, 1119 aa, unidentified
  REGION 1..1119: note = Description of Unknown:uncultivated organism sequence
MKGLCMSKLILSLDLGITSCGFSVLEELQESYRLIDYGVIMRDNPFDGNTQSDRSLHKQGRVLLDKKLSRVKKIKKIFLEFGIAYEDTNYQNLWQLRAVDVFERKLRGSEFFALLRYLAKHRGYKSLKIEDLIAEIEAKEKIGNCESDEISTPDIHNFSETLAYLDALKCKHKDKTAAQIIYELESNKPNPTFRNHDDYRYMIRREDVAKELVMMVHSQQKFGFFASKEEAEDFLTQVQEIIIKQDAVTLNPDLINNCLIYKDEKCAPIFSFTFDLFNFHKLLNDLKIDGEKITQEQKAMLADDFYNRLQTGKNFSGYTVKEIKKILGIESEFSKINNISEYKILKGKKVANTLVKFNFLSKLSKYDKEILESVFKQEESFLDSLSTAIHRNVNPAALLEEFYLLFKRYDMQFSEDEIQNFALTLYKEKTKGVSAYSFKALHELLDYMKEGKSESDAKEILGVGKSEDYSIFAKGVKYLKPIDKTGTLQYEVDENRISNHVVKSLVSWANRLIIDLHDKYGAFDVIKLESTRELSTPEDVKSKIKSANDKNQKEWEDLKKRYEKAAQAKGINLDNSSSYVLKLKLWEQQKEMGIYSLKMLSLDDILSDTTEIEHIIPRACGGSNAEYNKAVDLKNENAKKGNRIPLDYLTGEKKEQYKSFVDELKKEYKINFKKFKNLMATSLDDAYKEVRDEVSLHATSYAEKLLGEILKRYYPFKETLKQNQRVMHISGRATSYLRRILSIDNKSRDTNFHHAEDAILIALMSRSYLQKISTNFEENYEITQEKAKENFKKIVPLIDGASPNEIFAHLRKSYMEDIEDNPFYTGLDRSLRTPTFWVSKKPIGTKAHNETIQSKKNLSYRVSVESLFEKVKPNYKMSVEEFVNKYDKEVYQKLQIVQDNPKDYTAVAFRQRRDEVVKLLQEAAFITTKDEQQELNKKLLEVMRKPVFDVNGNVIRRVKRVGEVASIEVRNGLAYTAPSLVSLRCGYIEGESKLSLKRIDIRAYVKNKTAAPNEMDIFNNDLVEVYLLKKRELFKRIVGIVKGFTESKGGRINIRNPKYPLLKEKQPKLYQSEISIGSSCGIKKYKTDASGKVLGFYYLGRVQHEDEELFSKVLAYRRI

SEQ ID NO: 8721 - protein, 1129 aa, unidentified
  REGION 1..1129: note = Description of Unknown:uncultivated organism sequence
MKKILAVDLGITSFGYSILQETSRNSYQCLDNAVVMRSSPYDEKSGESSQKQRSSQKSLRNLNQKRKKRIKCVAKIFDHYGLIPYQKSLKINRDNPIKNKWDLRAITAWQRLLSPEELFAIFTHMAKHRGYKSIATDDLLYELEMELGLRNLETEDSKKSDERSQVYAALNRLEELKKSYGSETIAQVIHRAVAEGKFRSYRNHDDYEKMVRREDIEEEIEKIILKQAELGALPLDNKQIGGLIDDLKECITDQEMSTIDESLFGYCTFYKDEIAAPKYSYLYDLYRLYKKLADLKIDHYEVTPEDRNRIIQWIEEKIKAGKNIKSITHKEIRKILGLSPHQKIFGQEDERIIKGKKEPRVFVPFFFLANISKFKKIIASIQKHPDARQIFKELAEILQRSKTPRESYDKIEKLLQSKGIYASEAEIVELFRNKQPGTLELSHRYILQTLPLFLEGMDEKEIQRQLGFPDSEDYSGYPKSLRHLHLRDGNLFEQSVAPINNHAIKSLASWALGLIADLSWRFGPFDEIVVESARDTLPEKVRKEIDKAMREREKALEEIIKKYKDQFPTIDKRLARKIQLWERQKELDLYTGRTIKLSDLLDGSADIEHIVPRSLGGLSTEYNTIVSLKDANAKKGNRLPGDWLSNDDTYRRRIDMLKDKGLIDWKKHKNLVAASLDEIYKENMHSKGVRATSYLEALVAQVLKRYYPFPDPEARRHGHTVRMIPGRVTSKTRSFLGIKSKSRDTNFHHAEDALILAIIDRGWQNRLHRMLRENYGKSEDELKKLWERYSPHIEGLSIADYLKEAFERYMSKGEESLFYRDMFGGIRSVSYWIDKKPLSASSHKDTVYSARHSIPTLRKSIFDAFAALEVVKNRHKLTAESFMKLYGKEIRQKLWLNRIGNLNDESYRAVESRAAKIAETINRYQLMDAQNDKSMDDEYQRELKALLAAPIEVNGKQLRKMRFMINKNTIPINRGLVETDKNMLGIHLSKGPKGKLTIQRVDVNNAHKLKRQREGLFCYLNEMLFFFNEKKLIHSGCLRSFSINNQGSKYVKLFNPKFPSNPKAQPKKFSTGSSTRDVSVGSTTGVIKVHLDMDGHVKSYELFGTVTSEQLRWFIEESGYGGVENDTNH

SEQ ID NO: 8722 - protein, 1133 aa, unidentified
  REGION 1..1133: note = Description of Unknown:uncultivated organism sequence
MKKILSLDMGITSLGFAILEVVDDNSYKVVDNAVIMRDAPFDIKSGESTQSQRRMHKSMRALNEKRKRRVKEVARIFERFGLLSFQECMKVQKENKIIDKWELRAKDALQRPLSHEELFAILAHMAKHRGYKSIATDDLLYELELEFGLVDSIVEKVESKEDEKRQVYAALNRVEELKRVYPSETIAQVINRAVKERKLNSYRNHDNYEKMIRREDIEDEIERILIKQCELEGIALSEEECKHLIEDLHKAITEQVMPENNPELFGKCSCYTEEIAAPKYSYLFDLYRLYKILSDVRINNIALNEEQKERIVVYVQEKIAKGKNLKKLTYKDIRKILSLKPNQKIYGKEDEIVIKGKKSQRDLIKFFFISEIGKFSTLMAEVIKHPDHLNILARIAEALQLHKTPQESFRAIDALLKERQIRVAPDEIIALIKGFKPGTQNISHKFIIDALPHFMDGKSEDEVKEILGIRTSEDYGCYPKSLKHLHLGKENLFEKYVRPDINNHAVKSLVSWALRRIADLSWRYGSFDEIIIESTRDALPKSIQDDIDKAMREREKELDKIIDTYKKEFPSIDRKMARKIKIWKSQKEMDIYTGKIINISDLMEGRADIEHIVPRSLGGLSAEYNLVIAHRDANMQKGNRLPMDWLGEDKEYINLVEMLFNEHRISWKKRKNLLAKSYDEIYNEVKDSKALRATSYLEALVAQNLKMFYPFPDEEHRKNGAAVRNVPGKTTSKARQILGIKSKSRDTNWHHAEDALILATLSRGWQNRLHRTLRDNYGKSEEELQKIWQRFTPHLDGMTVSDYIKESFERFMSFGEDSLWYRDMFGSIRSVSYWVNRKPLSVSSHKDTVYSAKHAVPTLRKSLLAAFGGLNVITDRHKLTAESFMEKYDKEIRSKLWLHHIGNDNDPVMRAIDARAEAIAGVLKAYEMQDTKKDKELDETFKESLNTILSAPIEMDGKIVQKTRFVYSKLKGMDRKVRKGFVETDKNMLGIFVTKGSKKLEIVRMDVNNINDLQKEKEGIRVYLNEMIYLFNEKKVLHYGCLRSYLENAQGAKMIALFNSRFPANPKSQPKMFSTGSQIKQVSIGSTTGIVKVHLDINGSVKSYEKFGFIPKELEEEFKLECGYGGVEDDTHY

SEQ ID NO: 8723 - protein, 1130 aa, unidentified
  REGION 1..1130: note = Description of Unknown:uncultivated organism sequence
MKKILALDLGITSLGYSVLEEAGEHSYRVLDNAVIMRDAPFDKQSGESTQSQRRVQKSMRRLNEKRKRRVREVARIFDRFGLLSFEQCMQIQKENKIIDKWRLRAEDALQRPLSPEELFAIMAHMAKHRGYKSIATDDLLYELEIELGLADPLDTQEGSNADEKRQVYAALNRVEELKKLYPAETIAQVIHRAVQEGRLSAYRNHDNYEKMIRREDIEHEIETIIVKQCEMGAIELEEEKCKELIESLQEAITDQVMPENDPELFGRCSCYPEEIAAPRYSYLFDLYRLYKIVGDLKINGIALDDDQKERLIAYVEEKIAKGKSLKSLTYKEVRKILSLAPDQKIYGKEDVVIIKGKKSQRDLIKFFFISEMGKFANLVAEVVKHPERLKLFARIAEALQLHKTPQESFKAIDTLLKEHEIAVEPNEIIALIKGFKAGTQSVSHKFIIDALPHLKEGAEEYKVKEILGIQTSEDYGSYPKSLQHLHLGKNNLFEKYVRPDINNHAVKSLASWALRRIADLSWRYGPFDEIIIESARDALPKYIKDDIDKAMREREKEIDKIIDAYKSDFPSIDRKMARKIKIWKSQREMDIYTGKIINISDLIEGRADIEHIVPRSLGGLSAEYNLVIAHRDANMQKGNRLPMDWLGEDEEYIKRVEMLHDKHLIDWKKKKNLLARSYDEIYNEVRDTKSLRATSYLEALVAQNLKMFYPFPNKEHRKTGEAVRNVPGRTTSKARRILGIKSKSRDTNWHHAEDALILATLSRGWQNRLHRLLRDNYGKSEEELKEIWQKYTPHLEGMAIADYVKESFERFMSLGEESLWYRDMFGGRRSVSYWVNRKPLSASSHKETVYSGKQEVPTLRKSIAQAFDGLNVVKDRHKLTAETFMKKFDKEIRSKLWLHHIGNDNDPVMRAIDRRAREIAAILERYEPYDTNKDKERDEAFKEELNAVLTAPLEADGKLVRRTRFVYDKLNAIEIDRGLVETDKNMLGIHLLIRSGKLQISRLDVNNAYQIKQSEGMRVYLNEMIYLYNDKKLLHYGCLRSYLENAQGAKMIALFNSRYPANPKSQPERFSTGSQIKQVSVGSATGVVKVHLDIDGRIKSYEKYGMIPKEFEEAFRQECGYGGVEDDTDH

SEQ ID NO: 8724 - protein, 1128 aa, unidentified
  REGION 1..1128: note = Description of Unknown:uncultivated organism sequence
MSKILAIDLGTTSFGYAVLHDIDGSRYVCLDNTVVMRDKPYNEKGESPQGSRAVQRSLRRLIEKRKKRIRCVAKTFEFFGILEHKKALELNDPARNPIKDRWELRAVVAWERPLSPEEFFAVFAHMAKHRGYKSIATDDLLYELESELGLIEVSEQEKAVDDERRQVYQALERLERLKQEYRTETVAQTIHRAVSEGKLRSYRNHDDYEKMIRREDIEDEIEKIVLEQSKRGSLDLSENEVGEFIDALKECITDQKMPTIDESVFGHCTFYREEKAAPKYSYLYDLYRLYKKLADLKIENYDVTPEDRTKIVKWVEEKVGKGRNLKRITYGDVRKILGLGNGQKIFGVDDDRIVKGKKVPRVFVPFFFLAELSRFKQLFSAIARHPSNRVIFRELSEILQFSKTPKESFEALNAMLKRESIEADSKEIVELFKNKKSGTLTLSHRYILEALPLFLEGMDEKEIQRHLGFSESEDYSQFPKSLKYLHLGEGNLFEAEGNVINNHAVKSLASWALGLIADLSWRYGPFDTIVVESAREVLPEKVRKEIEKAMKEREKRVDVIIEQYRSEFPTIDRRLARKIELWQQQKEMDVYSGEVIGLTQLLDGSADIEHIVPRSLGGLSSGYNTIVALKHTNADKGNRLPGDWLAGDEAYRNRVEMLFAKGLIDWKKRKNLLAENLDEIYTETFDSKGLRATSYLEALVAQILKRFYPFPDEAHRKNGAAVRLIPGRVTSRIRSLLKIKSKSRDTNFHHAEDALILATISRGWQNRLHRMLRDNYGKSEEELAQVWEKYTPHIEGVSIADYIAESFERFMSKGEESLFYRDMLGGLRTVSYWVDRKPLSASSHKETVFSSRHNVVTLRKNILGVFLALDVVKNRHKLDGDTFMELYNKEIRRKLWLYRERNFNDESYRAVERRAAQIAETIDRYRQRNVRADKEADIEYQEALRILLQTPLSAAGKTIRRMRFVYEKLNPHRIDRGLVETDKNMLGIVIRRRENGKLSIVKIDVNNAGKMLTVSEGMIVYLNEMLYLFGERGLLHYGCLRSYVDNRRNIALFNPRFPANPKAQPKKFSTGSQIKQVGVGSAVGVIKPRIDLDGSVKSFQVFGEVTTEQVTWFKKETGYGGVENDTHL

SEQ ID NO: 8725 - protein, 1142 aa, unidentified
  REGION 1..1142: note = Description of Unknown:uncultivated organism sequence
MGKKILAVDLGITSFGYSVLEESKDNSYICIDNSVIMRDAPYDKDGKSKQTNRKEQTSQRSLGEKRKRRIKEVAKTFDAFGILSYDECMQVQQENKIIDKWKLRAEDALHRVLTSQELFSLLAHMAKHRGYKSIATDDLLYELELELGLRKEEFEEESKADEKRQVYAALSRLKRLKDTYKIETIAQVIHRAVEEGEFRSYRNHDDYEKMIRREDIEHEIETIVKKQYELNGLEFDEQTCLSFIEELHEAITDQIMPENDESLFGQCSYYPEETAAPKYSYLYDMYRLYKILADLKIDNYEITQEDREKIIDFVTQKVSTGKNLKQVYYKDIRKVLGLSENQKIFGKDDQSIVKGKPTQRTLIKFFFLSEISKFSVLIKKVLSHSKALEIFVQIAEKIRLHKTPKPAFEALNELFDEYDIEVVNAEILALIKGKSAGTLAISHKVIMDALAHFKEGKSESEIKEILGVNTSEDYSTYPKSFKHLHLGKNNLFEKSQNHINNHAVKSLASWALQNIADLSWRHGAFDEIIIESARDVLPKSIQDAIDKSMREKEKEIDKIINTYKKEFPSVDRKMARKIKLLESQKFLDLYSGEVINMNDLFEGRADIEHIVPRSLGGLSTDYNLIIAHRNTNMQKSNRLPMDWLQGDTTYVNRVEMLFGEHKINWKKRKNLLATSLDEIYVEVQDTKSLRATSYLESLVGEVLKMFYPFPNKEHQKNGISVRSVPGKTTSKTRSWLGIKSKSRDTNFHHAEDALILATLNRGWQNRLHRMLKENYGKSAEELKKLWQKYTPHIEGITIADYVKEAYERFLSKGEGSIWYRDMFDGIRSISYWINKKPLSASSHKDTVYSAKHKDPQNNEKILPTVRKSILGAFSGLDILKNRHKWNKEAFMKVYEKDIEQKLWLYRLGNTNDPVLRAIQERANAIGSLIENYIFKDPQHDKAVDELYQKEIRNLLHDAIIAGGKPVYKVSFVDDTFSPIEIERGKGNKVLVRTDDNFLAVMFEKGEKEKLIISKIDMNSLHQLKKQNAMIVYPNEVIYLFNKKKIIHYGALRSFLIKSSGARQIALFNPRFPSNPKSQPRNFSDGKSIKSVSIGSTTGIIKVQLDMNGKMKSYQKFGLIPKELEEAFLKESGYGGMEDNTDN

SEQ ID NO: 8726 - protein, 1132 aa, unidentified
  REGION 1..1132: note = Description of Unknown:uncultivated organism sequence
MGKKILALDLGITSLGFKAVQEAGENSYRVIDHGVIMRDAPFDVKSGESSQKQRSTQKGQRDLNEKRKRRIKKVAHIFESFDISDFETCMQVQKENRFVDKWRMRAEDALSRKLSAEELFAIMAHMAAHRGYKSIATDDLLYELELELGLIEKSTEEKEAKDEKRQVYAALNRVEQLKKKYPSETIAQVIQRAVEEGLLSSFRNHDNYEKMIRREDIEDEIATIIQTQYEFGLFDDEEKKDHFIEALHEAITDQTMPENDPALFGKCSFYTDEIAAPKYSYLYDMYRLYKTLGDLSIDNYQVTQEDREAIVAYVEEKIKSAKNIDKITYKEVRKILSLPNESKIFSREDEQVIKGKKSQRAFVKFFFLPKIKNFPHTMKSVVAHPDSLKLFAQLAEIIQQEKTPKPSFERISSLLKSHGIEVHDKEILALIKGYTPGTLSMSHRYIQDALPHFSEGKNEVEIKELLGINTSEDYSHFPKSLKHLHLGKDNLFEKQPQNSINNHAVKSLASWTLKRIADLSWKHGLFDEIIIESARDALPETIKKEIEKGMREKEKELDKIVEAYKKEFPSVNRKMARKIRLLESQKFMDLYTGDVINISNLFEGRADIEHIVPRSLGGLSADYNLIIAHRDANMQKSNRLPMDWLGGNSEYVNRVEGLFAEHLINWKKRKNLLATSMDEIFNEVKDSKALRATSYLEALVAENLKMFYPFKEEKARKFGHEVRNVPGKTTSKARQILGIKSKSRDTNWHHAEDAMILATLSRGWQNRLHRMLKENYGKSETELQEIWQKFTPHLECMSIAEYVKEAYERFMSLGEESLWYKDMFGARRSISYWVNRKPLSASSHKDTIYSGRHEVPTLRKSIIAAFDALNLITNRNKLNSESFMKLYEKEIRSKLWYVHNANTNDPVMRAIDERAKQIAKLIDSYILKDPQHNKEIDEQYKTELSDLVNKSIDVDGKVVRKVRFVYEKLNAVQINRGLVETDKNMLGIFIQKGEKKLMISRMDVNNAHELEQNKNGLRVYLNEIIYLYNDKKLLHYGCLRSFVEGNGKIALFNPRFPANPSSQPKFFSTKNEKTTGQIKQIGVGSATGIIKVQLDLNGQMKSYQKFGTIPKELEMQFLKESGYGSMEDDTHH

SEQ ID NO: 8727 - protein, 1135 aa, unidentified
  REGION 1..1135: note = Description of Unknown:uncultivated organism sequence
MNIYSGGRIMGRKILSLDLGITSLGFNVAKEVGENSYKVIDNGVLMRDAPFDVKSGESSQKQRSIHKGQRDLNEKRKRRIKEVARIFDKFGILNFEACMRVQKENRFIDKWRMRAEDALNHKLSEEELFAIMAHMAAHRGYKSIATDDLLYELELKLGLIEETITEEEAKDEKRQVYAALNRVEQLKKRYPSETIAQVIHRAVGEGALSSYRNHGNYEKMIRREDIEDEIAAIIQTQFEFGLFENEEKRDKLIDAFHEAITDQTMPENDPNLFGRCSFYPDEIAAPKYSYLYDMYRLYKTLGDLSIDNYQVTQEDREVIVAYVEEKIKSGKNIKEISYKEVRKILSLANECKIFGREDEQIIKGKKSQRAFVKFFFLPKIKDFPQTMKSIILHPDSLKLFARLAEIIQQEKTPKPSFERIKSLLTSHGIEVHTKEVLALIKGYTSGTLSMSHRYIQNALPHFAEGKIEVEIKELLGINTSEDYSRFPKSLKHLHLGKDNVFEQHQNSINNHAVKSLASWTLKRIADLSWQYGVFDEIIIESARDALPDTIKKEIEKGMREKEKELDKIVEAYKKEFPSVDKKMARKIRLLQSQKFMDLYTGKSINISDLFEGRADIEHIVPRSLGGLSADYNLIIAHRDANMQKSNRLPMDWLSGESEYVNRVEGLFAEHLINWKKRKNLLATSMDEIFNEVKDSKALRATSYLEALVAENLKMFYPFKEKKARKFGHEVRNVPGKTTSKSRQILGIKSKSRDTNWHHAEDALILATLSRGWQNRLHRMLKENYGKSEAELQEIWQKFTPHLEGMSIAEYIKEAYERFMSLGEESLWYKDMFGGRRSISYWVNHKPLSASSHKDTIYSGHHEVPTLRKNIIAAFEALNFISNRNKLNSDSFTKLYEKEIRSKLWYVHNGNTNDPVMRAIDERATQIAELIDSYILQDPQHDKEIDEQYKRELGDFVGKPIEVDGKIVRKVRFVYEKLNAVQIDRGLVETDKNMLGIFIEKGEKKLKISRMDVNNAYELEQNKNGMRVYLNEMVYFYNEKKSLHYGCLRSYVEGRSNIALFNPRFPANPKVQPSIFSTGSQIKQVSIGSATGIIKAQLNFNGQIKSYQKFGYIPKEFEEVFKKECGYGSMEDDTDH

SEQ ID NO: 8728 - protein, 1142 aa, unidentified
  REGION 1..1142: note = Description of Unknown:uncultivated organism sequence
MGRKILSLDLGITSLGCTVLEEERENSYRVLENTVIMRDAPFDNSGDSSQKQRSTYKSQRSLNEKSKKRVNALARLFDEFDLLSFDNCKQIQKENKYIDKWCMRAEDALNRKLSSEELFAIMAHMAKHRGYKSIATDDLLYELELELGLIEAIDEEDAQKDEKRQVYAALNRVEHLKKEYPSETIAQVIHRSVNEGKLSAYRNHDNYEKMIRREDIEDEIETIIETQQEFGLFDDDSKAEKFIEQLHEVITDQVMPENDPDLFGKCSFYRDEIAAPKYSYLYDMYRLYKTLGDLSIDNYEVTQDDREAVVSYVQEKIKSGKNIDKITYKEIHKILSLKDEHKIFGKEDVQNIKGKKSQRVFVKFFFLSKTKEFAQTMQAVTSHPESLHIFAELAEIIQQEKTPKPSFERIKTLLEDHNIEATPKEILSLIKGYTAGTLSMSHRYIIDALPHFAEGKREDKVKELLGISTSEDYSGFPKSLKHLHLGKENLFEQYKKPPINNHAIKSLASWALRRIADLSWCYGIFDEIIIESARDALPESIKKEIEKGMKAKEKEIDKIIESYKKEFPSIDRKMARKIRLLESQKFMDLYTGDIINISDLFEERADIEHIVPRSLGGLSADYNLIIAHRDSNMRKSNRLPMDWLGGNSEYMNRVESLFTEYLINWKKRKNLLATSMDEVFNEVKDSKALRATSYLEALVAENLKMFYPFKEEKARRFGHEVRNVPGKTTSKARQILGIKSKSRDTNWHHAEDALILAILSRGWQNRLHRMLKDNYGKSDAELQEVWQKFTPHLEGMSATEYIKESYERFMSLGEESLWYRDMFGGCRSVSYWVNRKPLSASSHKDTIYSSKHRDPNDPDKVMPTVRKSILGVFGGLDILKKRHKWNKEEFLKVYDKEIRQKLWLYRLGNINDPVYRAIDERANAIGDLIETYIYKDPQHDKAVDEVYQDEIRLLLQTPITAAEKPVYKTAFVDDTFSPIEIQRGKGNKVLVRTDDNFLAVMFEKGEKEKLHISKVDVNSLHRLKQENAMIVYLNEVIYLFNKKKIIHYGALRSFSINNQGGKYLKLFNPRYPSNPKAQPKMFTTGSSIKDVSIGSTTGVIKVQLDINGKMKSYQKFGLIPKDLEEEFLKESGYGIVEDNTDH

SEQ ID NO: 8729 - protein, 1128 aa, unidentified
  REGION 1..1128: note = Description of Unknown:uncultivated organism sequence
MEKNMTKILSLDLGITSCGYAVMQEVEDNSYLLLDYGVVMRDNPNEGGTQKERREKKQSRELLDKKKNRVKQIQQLFELHGLAYQDTKHYDIWKLRSIDAFERKLNKDELFALFRFMAKHRGYKSLKIEDLIAEIDAKEKIGDCESTEINMPTDLEKFSETLAYLDALKCKHKDKTAAQIIWKLESQKENPTFRNHGNYRYMIRREDIKKEIEKIIEAQQALHFFHNEQHAKEFADKAIEIIVPQEAVTLNPDNINRCLIYKNTICAPLFSYSFDMFQVYKLVADLKIGGMNASIEQKELLLQHLLDDIKNFKCKNIYSVKDFKKILEIDDDSVKINNFQEFKTVKGKKESNNLIKFNFLPSLKKLHSDKKLDANMLDFLFAHEQSIEIFDAIATEIHLNVNPEKLLKNIQELFTRYEFEFSEDAVRDFTLALHKNKVSGTSSYSFKALKDLTLLMQEGKNESDAKEILGVSKSEDYSRFSRGIAYLKPQNKEGQLRYEMDENRISNHVVKSLINWALRVVIDLHAKHGTFDVVKLESTRELSQPDDVKRDIKAANDKNEKEWLGLIEKYQKHFEAKGLNLQNNKEYLLKLKLWEQQKGFGIYSHKVLSIDEVLSDKTEIEHVVPRACGGSNAEYNKALDIKDENAQKGNKLPLDYLNGEKREVYINFVKELKESHAINFKKFKNFMAEELKDAFKEARDDVSLHATSYTETLLGEILKRYYPFSDALKENQRVMHISGRATSYLRRILGIDNKSRDTNFHHAEDAILLGVMSRSYLQNISTNFEKNYELTLQNAKENFKKIVPTIEGASPHQIFAHIRESYMEDIENTPFYKALDGTLKTPAFWVSKKPIGTKAHNETIQSKKNMAYYVPVSSLLDKVKPSHKMGADEFYKKFNQEVYEKIQVVQDNPKDFTSQAFARKRDEVVALLNKSAFVSTKDEKTELDKELRDLMAKPLYDVNGNEIRRVRRVGEKVSIPVRKGYAGNAPSMLAMRCSVETQTRLFTDRIDFKDSILLKKNDGSYIDIFNNDLVKIFTYEKKQVVLKLTGLLRTFVINAKEDKMLKVKNPKYPIREEAQPKQYNSYVAVKKMCGIKKYKTDASGKILGFYYLGTILDDEKELFAKVLSYKAL

SEQ ID NO: 8730 - protein, 1111 aa, unidentified
  REGION 1..1111: note = Description of Unknown:uncultivated organism sequence
MNRILSLDLGVTSCGFSVLDEVETNQYSLIDYGVVMRDNPNEGGTQSDWKAYIQQRKLKDKKKQRVKDLKDIFKSFNLNFVEKNYSNLWELRAKDSFERKLQIDELFAIFRYLAKHRGYKSLKMEDLIAEIESQEKIGNCESDDVIEPNSEEFTETLAYLDALKCKFKEKTVAQIIYDIESQKENPNFRNHNNYKYMIRREDTKDEIEKIVEAQKLFGFFKDEKEAENFKNSIIDEIIPQDPVLLNPNLINNCLIYKEEKSAPIYSYSFDIFNFYKHINDLKIGNKNATNEQKEILTNDFELKLKELKNISSYTIKGIKELLDIKDDIKISGLRETKIVKGKSVDNYLVKFNFLAHWAKFDKEIVVALKDKINYFDKIATIFHININPNALIEGFSKYFKENNLFFEEEKIKNFALSLYKNKVKGTSAYSFKALNDLIVHMKDGKNESDAKEILGISKSEDYSSFEKSIKYLKPIDKNGTLRYEIDENSISNHVVKSLISWACRIIIDLHEKYGSFDMIKLESTRELSQPDEKKREIKSANDRIQKEWEDLKDRYKSHFEALGLNMGNNKEYLLKIKLWEQQGEIGIYSGQSLGIADILSDKTEIEHIVPRECGGANAEYNKAIDTKNENAIKARRLPLDYLVEEKREVFLQNIDELKNSKKINFKKWLNLKAQTLDETFKEVKDDVSMHATSYTEKLLGEILKRYYPFTDKQKENQKVMHISGRATSYLRKILSIENKSRGTNFHHAEDAILIACMSKSYLQNISTNFEKNYELTRENAKDNFKKIVPFINGANPNEIFSYLQKSYTQDIEENPFYTNVIDNTLRIPAFWVSKKPIGTKAHNETIQSKKNLAYRVNIDSLLERVKPNHKMSAENFFEQYNKEILEKVQVFKDNPKDFTAQAFIKKRDNIIQLLQEANFITSKDEKADIDKKLRDEMKKPIEDVNGNTIRRVKRVGEDATIEVRNGLAYTAPSLVCLRCSFDEPKLQLQRIDIRSHVQNRNKNDTQIDIFNNDLIEIYVIKSKKIEYKAIGVLKGFTESKGGRANLRNPKYPLLKDKQPKLFQGEFSIGSTCGIKKYKTDASGRVLGFYYLGRVLEGDKELFSKVVTYRKM

SEQ ID NO: 8731 - protein, 1131 aa, unidentified
  REGION 1..1131: note = Description of Unknown:uncultivated organism sequence
MSKKILALDLGITSLGYSILEELGEHSYSCLDSSVIMRDAPYDKDGNSNQTVYRGQKSQRALIHKRQTRIKNTAKVFEKFGILDFASCMLVQHDNNITDKWRLRAKDALQRSLSPQELFAIMSHMAKHRGYKSIATEDLLYELEMELGLIEEHVNDDEAQKDEKRQVYAALNKVENLKKQYHSETISEVIHRAVQEGKLHSYRNHDDYEKMIRREDIEDEIETIIQKQCEFGALKLTSSRCSEFIEALHEVITDQVMPENDTSLFGKCAYYPTEIAAPKYSYLYDLFRLYKTVSDLKITNFEIETEDREKIIGYLHQKIKNGKNINQITYKEVRKILSLNDNQKIYGKDDDIVIKGKSSARSLIKFFFLSDIAKFPTVVQKISQHEASIDLFGKVSELAREHKTPRPAIDAIEELLSLHGIETDKSELLELIRNKKPGTLSVSHRFIIDALPHLQEGKSETDIKEILGVKISEDYSSYPKSLKNLHLGKDNPFEMYQNKINNHAIKSLGSWILQRIADLSWRYGAFDEIIVESARDALPKSIQEAIDKGMREREKEIDKIIEAYKNEFPTIDRKMAKKIKLLESQKFMDIYSGDMINISDLFEGRADIEHIVPKSLGGLSADYNLVIAHRNSNMKKSNLLPMDWLNEDSGYVNRVESLFKEHLISWKKRKNLLAKSLDETYVEVSDTKALRATSYLEALVTENLKMFYPFQTQAHRANGVAVRNIPGKTTSKARSLLGIKSKSRDTNFHHVEDALILATLNRGWQNRLHRMLKDNYGKSEKELKTLWEKFTPHIEGVAIGDYVKEAFERFMSMDEESLWYRDMFGGRRSISYWINKKPLSASSHKDTVYSAKHAVPTLRKSITGAFDGLGIVKDRHKLDGEYFKEIYEKEIRKKLWLYHIGNLNDPVLRAIDNRADEIVQVLHRYENGDIKKDKELDETFVNELNNILRNPIDVDGKIVRKTRFVYTKLNAVEIDRGLVETDKNMLGVFISKAENNRVKIERMDVNNAPKLLKRNSGLKVYLNEMIYLFNEKKVIHYGCLRSYVEKTGNSKLVALFNPRFPASPKSQPKMFSTGSQIKQVSVGSATGVIKVHLDLSGQIKSYEKFGMISKELENEFLQECGYGSMEKHPDH

SEQ ID NO: 8732 - protein, 1078 aa, unidentified
  REGION 1..1078: note = Description of Unknown:uncultivated organism sequence
MRDNPSDGGTQKDRSGYLQSRSLKEKKKNRVNKIKTLFILAGLNYKDKINYDIWYLRAVKSFNEKLSNDELFALFRYFAKHRGYKSLKIEDLIAEIESQEKIGDCEGGEIIPPKDLEKFSDTLAYLDALKCKHKEKTVAQILWEIESASPTPTFRNHDNYRYMIRRDDIGKEIETIVRTQHTYGFFDPGFDIETFIDSLKKIILYQAPVRLNEALIGNCTIYKNEKCAPIYSLAYDRFNAYKLINDLKIGNNSATSEQKERLIAYIDNKIAEAKNLVGLSVKELKAILDINDEALKLNNHGEYRTIKGKKEPNHLIKFSFVSKLSKFDSDLLKTLLSHQERDQIFDQIATIIQRNINPENMLNAFKELFQTIRLNTDEDTIRTFALSLFKEKKSGSGNYSFKALGDLTRLLLEGKNETDAKTVLGVSSSENYESFAKGIKYLHVNQYENDEAVISNHIVKSIASWAIRIIKDLHDKHGPFDQINIESTRELSQPEEIKRQIKSSNDANEKEWQELIRKYTPHAIQKGINLSQSPSYVLKLKLWEQQKFFGIYSHQPLGIDDILSEKTEIEHIVPRACGGSNAEYNKAVDLKNENMQKGNRLPLDYLHDERRSIFIGFVAELKETGLINWKKMKNLLAESLDETYKEAKDTISLHATSYAEKLLGEIIKRYYPFMDESKRRNGIGVMHISGRATSYLRRILSIENKSRDTNFHHAEDAIILGLMSRSYLQNISTNFTENYAKTVQEAKENFKKIIPLIDGAHPNEIFAHLRKSYEQEIETNPFYKGLDGSLRIPSYWVSKKPIGTKAHNETIQSAKNFAYYVPVASLLGRIKPNHKMHPDDFKKSYDTEVLEKLQVFQTNPKDHTAKAFVARRDETIAILNKANFITSKDEQSEIDKALRSAYNAPILDVNGNPMRRVKRVGEEASISVRGGVAYTAPSLLSMRCEYADTTKLVLKRIDIRAFASSDQIKAHQIDIYNNDLIEIFIIKSKSIESKVIGILKGFTESKGGRANIRNPKFPALKEKQPKIYQNEISIGSICGIKKYKTDATGKVLGFYYLGRVKEESAELFSPVVAYRKLL

SEQ ID NO: 8733 - protein, 1117 aa, unidentified
  REGION 1..1117: note = Description of Unknown:uncultivated organism sequence
MSKKILSLDLGITSIGYSILNELENNKYTLIDYGVSMFDKATDKDGNSKKLLHSESESSKKLHKLRKDRKRNLAELFQKYNLGNKNELLNQEKENINSNKWELRAKKAFEEKLTISELFSILYLISKHRGYKSLESTDLLEELCIKLNIDLDETKKDKKNDEKGKIKLALNTIENLKEKSDKTVAQLIYEIEIKKHNPTFRNHDNYNYMIRREYINEEIEKIISSQKSFSFFMDEFNIDSFITDIIKTIDDQKESTNDLSLFANCEYYPNEKVAHQYSFLSDIFKMYQSVSNITFNIKPQIKINKEQIKLISNDFFKKIEKGKNINDIKYKDIRNILELPENIKIFNKEDYYLSNGKKQENTIIKFHFLSNLSKIGNKFILDILKKENMYEIFKEIFDVLEFEKSPKLIYEKLKEYIDDDKTIINLIKYKSGNSLNISAKAMIDFIPFFENGLNMDEIKKELNLNRHEDYSDYKKGIKYLHISQFEKDDSLKINNHPVKYAVSAIIRIIKHLHITYGGFDEIKVESTRELSQNEQTRKDIEKANRALEKEINTILENKEYQRISENYGKDLQKYARKILLWESQERFDIYTGKSIGFEDIFTNTVDLDHIVPQSLGGLSVNHNFVLTHRDTNLRKSNQLPLNYIKDKQSYINRVEYLFSVHKINWKKKLNLLAESLDDIYKDTFESKNLRATSYIEALTAQILKRYYPFENKIKQKDGSSVRHIQGRATSNIRKVLKVKTKVRNTNIHHAIDAILIGITDHSWLQKLSNTFRENMGIIDDIARENIKKQIPLIDGIYPKELIEIIEDKYNEYGENSIFYKDIFNKTKAVNFWVSKKPMVSKIHKDTIYSKKENNIFTNRVNIINEFINLKTTINTNSKKFEESFEKNILKKMYLYKTNPSDVICKVVQKRADDIKELLNSFIYLDLKDKELVSESKIKLDELIHKELIDNNGNIIRKVKFFQSNLTGFDVRGGLATKEKTFIGFEVDITDVNLVYKRIDASNIHKVKKENHNSFKVYKNDLVFFIYPDRSFKGGKIVSFLEDKKVGAFSNPRFPANIGFQPHSFLTIFNGKANSHKQVSLNKAIGIIKLNLDILGNIKSYSKIGIIESEFLDFLKNK

SEQ ID NO: 8734 - protein, 1140 aa, unidentified
  REGION 1..1140: note = Description of Unknown:uncultivated organism sequence
MSKKILSLDLGITSIGYSILEEFKNDRYSLVDYGVSMFDKATDKDGNSKKLLHSASASTTKLYHLRKERKKALSQLFEEFGFGKKKYFLYQEKQNKYKNKWELRAKKAFEEKLKIEELFTILYTLAKHRGYKSLDSDDLLEELCSKLNIIMDEKKAKKADDEKGQIKKALLTIEELRKDSDKTVAQIIYELEMQKENPTFRNHDNYKYMIRREYIDEEIENIILSQVTFGLFSDTFDSDEFIEKLKKIITFQNPSTNDMSLFAPCEYFDEFKSAHQYSIISDIFKMYQSVSNINFNKEKTPITKEQIKLISDDFFMKIKKGKNIPDIKYKDIRKTLKLSDDIKIFNKDDEKLTITKFHFLCSLGKIDNTFIVEALEKKNGYEILKGIFEVLQLSKDPKDIYEQLKEKIDDQTIINLIKNKTGNSLNISAEAMIQFIPYFEDGFTMDKIKGKLNLNRNENYSEFKKGIKYLNIKQFEYDDKLEINNHPVKYVVSATLRVIKHLHTTHGIFDEIRVESTRELSLPTKEQVSKAKKSGKPLSKKQKTRESIDNVNKKNEAKYLAVLNNTVYIDTSNKYNKNIQKYKERLVIYEEQKRRDIYTWKGIELEDIFKDKLEIDHIVPQSLGGLSVKHNKVLCFKSSNAEKSNRLPMNYIKDTESFIKNVKYLYSKGCINGKKLKNLLATNLDETFKDTFQSKSLRATSYIEALTAQILKRYYPFKNEKKQKDGSSVRHIQGRATSNIRKVLKVKTKVRDTNIHHAIDAILVGVTNQSWLQKLSNTFRENMGVIDDKARENIKKDMPLFEMIIDDEVQYLEPKELIEMIEDRYNEFGEDSIFYKDVWGKTKAVNFWVSKKPMVSKIHKDTIYSKKQDGIYTVRENIINQFINLKTTISTTSVKFEESFKKNILNKMYLFKTNPNDVICKVVMKRAEDIKVLLDSFVDIDTKDKELVSQSKQKLDELIHKDIKDNNRNVVRKVKFYQTNLTGFNIRGGLATKEKTFIGFKASLEDEKLHYTRIDVSNFDKIRKENDNSFQVFKNDLVFFIYPDGSFRGGKIVSFLEDKKIASFSNPKFPSASEFQPISFCKIGKDSNNNPKKSGAKQQGINASIGIIKLNLDITGNIKSYQKIGRCESELLEFTKDIKV

SEQ ID NO: 8735 - protein, 1113 aa, unidentified
  REGION 1..1113: note = Description of Unknown:uncultivated organism sequence
MKILSLDLGVTSCGYSVLHQIAPNSYSLIDYGVVMRDNPYDGGTQKDRREHHQSRSLIEKKKDRIKAVQKLFDNSGLSYHDKKFYDIWKLRAIDVFERRLENDELFALFRFLAKHRGYKSLKIEDLIAEIEAKEKIGDCDSGEIKIPEDTQKFTETLAYLDAMICKYPDKTAAQVIWELENDRKNPTFRNHGDYRYMIRREYVAKEIDKIVRAQHEFGFFDNKNELIVFIEKLQEIIIEQDAVTLNPDNINNCLIYKDEKCAPVFSYSFDLFQLYKLVNDLKIDGVKITQDKREELLDTMLKSFRTFTCKASYSVKDFKKILGIDDANAKLNNYSESKKVKGKDTPNALLKFNFVHLLKKMDAEIIEVIFNNPLYVTILNEIATHIHMNVNPEMLIKEVGDTFQKHHLDFDDEQIKTFVLQLHKNKSSGTASFSLKALNDLIALMKEEKNESDAKEMLGVSKSEDYSHLLKGIKYLKPQNKQGQLQYEIDENRISNHVVKSLVSWALRVITDLHVKYGPFDSIKVESTRELSQPDDVKREIKKANDSNEKEWNNIKEKYKLHLQNLENSKTYLLKLKLWEQQKELGIYSHKSLGVDDVLSDKTEIEHIVPRACGGSNAEYNKAIDFKDENARKGNKLPLDYLSGDKREVYIQFVKELKETRAINFKKFKNLMAEELKDAFKEAKDDVSLHATSYTEKLLGEILKRYYPFTDTLKENQRVMHISGRATSYLRRILSIDSKSRDTNFHHAEDAIILGVMSKSYLQNISTNFEENYEMTEQNAKENFKKIVPLIDGAVPNEIFAHLRKSYLEDIETNPFYKDLNGNLKVPAFWVSKKPIGTKAHNETIQSKKNLAYYVPISSLLEKVKPNHKMSSDDFYKLFNKEVYEKVQVVWDNPNDYTAKAFAQKRDTVVNILNSSAFVSTKDEKAELDKKLRDIMSQPLHDVNGNEIRRVKRVGEKVSIPIRHGYAGNAPSMLAMRCKAETENRLFTERIDFKDKILLKKNDGTFIDIYNNDLVDIYTFEKKQVILKLTGLLRTFVINAKEDKMLKVKNPKFPIREDAQPKQYNSYVAVKKMCGIKKYKTDATGKVLGFYYLGRVLDDEKELFTKVLSYKAL

SEQ ID NO: 8736 - protein, 1109 aa, unidentified
  REGION 1..1109: note = Description of Unknown:uncultivated organism sequence
MKKILSLDLGITSIGYSVLDELENDRYSLIDYGVSMLDSPFIDDRKRISKKLLHAQSKSSKKLFNLRKIRKQKLALLFEKYDLEKSEQLLEQEKANTYINKWQLRCEKAFNEKLKVGELFTIFYALAKHRGYKSLDSDDLLEELIRELNLEVKNNSKKKDDDEKGKIKKALRTVEALKEKYPNKTIAQIIYEEERKGANPTFRNHDNYNYMIRREYINEEIKRIVLSQKSFGFFKDNFSVDDFILELVKTIDDQKESTNNLSLFGKCEYFKEEKVAHQYSLLSDIYKMYESVSNITFNKEKNKITPQQIKLIADDFFEKIKKGKSFSEIKYKDIKIILKLDENTKIFNKDDGRIVKFHFLSNLSKIDNSFIKKAFEKEDKYQILQEVFDVLEFEKAPKKIYEQLKGLVDNKTIIDLIKYKNGNSLNISAYAMIKFIPYFEQGLTLSDIKKKLNIKESEDYSKFKKGIKYLYVSQFEKDNDNLEINNHSVKYVVSATLRLVKHLHSTYGAFDEIRVESTRELSQNEETRRNIEKANRALEKQIDEVLLNKEYQEIANQYGKNLRKYARKILMYEKQERRDIYTGEGIEFKKIFTNEVDIDHIVPQSLGGLSVKNNFVLAHRDSNVRKSNQLPSNFVSDKQAFINRVEYLYKENKINWKKRKNLLANNLDEIFKDTFESKSLRATSYIEALTAQLLKRYYPFVNEKKQVDGSAVRHIQGRATSNIRKVLNVKTKVRDTNIHHAIDAILIGLTNESWLQKLSNTFRENVGVIDDEARAKIKKEIPLIESIEPKELVSRIEKNYNSFGEDSIFYKDIFGKTKTVNFWISKKSTSSKVHKDTIYSKKEDGIFTMRESILNKFVSLKVTPKTTSVKFMEEFNKNILQKMYLFKTNPKDVICLVVQNRAEDIKNMLDSFEGIDAKNKELMSEAKQKLEGLIHGNLVDNNGNIIRKVKFYQTNLTGFDVRGGLATMEKTFIGFRAIFENGKLSYKRIDVINFKQMNNKNDGSFKVYKNDSVFFVYLDKTMKGGKIVSFLENKKIAAFSNPKFPSAYKFQPNSFCKDKSHTGAKQHSVGSAIGIIKLNLDILGNIKSYQVLGNAKSEFLETIKGIVNG

SEQ ID NO: 8737 - protein, 1119 aa, unidentified
  REGION 1..1119: note = Description of Unknown:uncultivated organism sequence
MKKILSLDLGITSIGYSVLDELENDRYSLIDYGVSMLDSPFIDDRKRISKKLLHAQSKSSKKLFNLRKIRKQKLALLFEKYDLGKSEQLLEHEKDNIYINKWQLRCEKAFNEKLKVGELFTIFYALAKHRGFKSLDSDDLLEELTRELNLEVKNNSKKKDDDEKGKIKKALRTVEALKEKYPNKTIAQIIYEEERKGTNPTFRNHDNYNYMIRREYINEEIKRIVLSQKSFGFFKDNFSVDDFILELVKTIDDQKESTNDLSLFGKCEYFQEEIVAHQYSLLSDIYKMYESVSNITFNKEKNKITPQQIKLIADDFFEKIKKGKNILNIKYKDVRKTLNLSEDVKIFNKDDSYLKDGKSVENSIIKFHFISNLSKIDNSFILNSLKQDNKYEVLKEIFDILEFEKSPKSIYVKLKTLVDDETIIDLIKYKNGNSLNISAYAMIKFIPYFEQGLTLSDIKKKLNIKESEDYSIFKKGIKYLHVSQFEKDNDNLEINNHSVKYVVSATLRLIKHLHTTYSTFDEIRVESTRELSQNEETRRNIEKANRALEKQIDEVLLNKEYQEIANQYGKNLRKYARKILMYKEQEGRDIYSGEGIEFKKIFTNEVDLDHIVPQSLGGLSVKHNFVLAHRDSNVRKSNQLPIDFVSDKQAFINRVDNLYKEHKINWKKRKNLLANNLDEVFKDTFESKSLRATSYIEALTAQLLKRYYPFANEEKQVDGSAVRHIQGRATSNIRKVLNVKTKVRDTNIHHAIDAILIGLTNESWIKKLSNTFRENGGVIDDEARAKIKKDIPLIESIVPKELVAMIEENYNSFGEDSVFYKDIFGKTKTVNFWVSKKPMSSKVHKDTIYAKKDDGIFTVRENIIEQFIALKITPETSSNKFVENFNKKILQKMYLFKTNPKDVICLVVQNRAEDIKNMLDSFDGIDAKNKELMSEAKQKLEGLIHSNLVDNNRNIIRKVKFYQTNLTGFDVRGGWATMEKTFIGFRATFENGELSYRRIDVINFKQMNNKNDGSFKVYKNDLVFFVYLDKTIKGGKIVSFLENKKIAAFSNSKFPSAYKFQPNSFCKDKSHTGAKQHSVGSAIGIIKLNLDILGNIKSYQVIGNAKSEFLETIKGIVNG

SEQ ID NO: 8738 - protein, 1082 aa, unidentified
  REGION 1..1082: note = Description of Unknown:uncultivated organism sequence
MAKNYIIGLDLGENNVGWSVIYPETNKIENKGVRLFNIAAAAADRRTSRDTRRRLKRRDNRLKESLILFESIQFPNENTIDANLLQKRIDGLKQQIEKQDIVNITCYYMTHRGYIPFGDEERELIQLNGKYPCEYYKDLIQKIGKYRALEQVVNHTDLLKEFKAILTNQMQYYPEIGKIIGDENQGLLWIFSRKRKFWEGPGSEKSFTPYGRFKDENDVVNYQKLKSTGKEKYLFEDLIGHCKIYPNEKCAPKANYYAEKFNLLNDFINIRINNYENIKNQNYIECHKAIHTKDTYYKLTNKALEDIFNYCIQFDEKSLQYTKVLKEVLGLNKNDISGYRIDKDGKPKFSLMNNYRLIKRLYKENDISFEWLNDLDSYNLLIANLAVVPGVVELTKMLDSIHKCDEKEQEILRTVQQKLKENRSLEYHALSEKALKRAINDMISTGMNYEQVSKKFDYEKEARELMVNGYGNGEGRLLMTSKYVDEIIASPAVKKTLRQSIRVINAIIEKEGEYPAVISIESAKEMNGDDRRKEIEKEQKLQEKYRQDAEEILKSCNANITNKNIEKVMLFEETNGHCAYCGKPVSLNDVLAGSYEVEHILPLSQSCDDSFNNKTIACRDCNARKGNKTPFQFLSDAEFDELSKRIKTMKLPEEKKYNLLYSEDVNKHQIRFFNRSLRDTSYATKELVNQVHLFNEYLKSNLNNTEIKTLSTPGQLTHKIREEWNLEKNRDIGKFHHAVDASIVAGIATTSIGKLIIQSQNDSQYWILHKDDLNQIPKLVTTFSMPEYKDKVSVIQSDDDVQISMQVNKDINRGFSNANITKFIKKDNEYYKIQQISDIYTPDLMRTDKKNLDILFDEKNPKYTLLCQEQDPKLFKMLQHIYTQYQDANTNPFVNYCKEKLPEDSKFNPLINGIRTPSKSGKGILVTKLRYMQSVENPYLLNKANIHKKENTLIGLDSVSIYCTRLYWDKDKKKILFMPIYAPVVNPVTGKINEQHPLYKLYYEQCIEGKNVQFIVDLFNGNYVEIEKSDGTTIKEYIKGYAKASSSIQCKSGKYLSPKDKFTLYDVDVLGNKIKRLTWPQD

SEQ ID NO: 8739 - protein, 1096 aa, unidentified
  REGION 1..1096: note = Description of Unknown:uncultivated organism sequence
MKEKKYIIGLDLGINNVGYSVIDEESKKILKKGVRLFNTADKAEERRIARNTRRRLKRRSNRVDETLKLFKSIHFPDEITIEPDLLQKRVKGLHEKLESQEIVNIICYFMMHRGYIPFGDEERTLVELNELFPCEYYLKKWREIGKYRALEEVVNHQDLKREMIALLENQMKYYPELSQIVGNEEKGLLWIFSRKRKFWEGPGSTRSFSEYGRFKNEEDVLKYQELKKEGKEKYLFEDLIGHCKIYVNEKCAPKANYYAEEFNLINDFLNIRVINRENILKESYVHQDTSKAYHLTTDAIEAIIEYCKNFTGKILSYNKVLKDVLGLTKEDIAGYRIDKDGKPLFSLLNAYRSIKKNYEEKNLDSSWLINDLENYNRLINILAVAPGKVEIAKMLENIHKFTQEELDVIGKIQEKLKKDRFLDYHALSEKALTRAIQDMKATCLNFMQVSKKFDYEKEACEYYLKNYGTGEGTLLMTSKFIDEIVASPQVKKTLRQAIRMINAIIEEQGNYPSVIAIESAKEMNGEEKIKEIERVQKIQEKLRKDAKTILENTVSDDKVTDNMIERVILFEEIDGHCPYCGKAININDVISNTAEVEHIIPISQSADDSLENKTIACRDCNSKKKNKIPFSYMSSTEFEEFTKRVLQLNISEKKRQNLLTTDDPNKYQTRFFNRNLRDTAYATKELVTQVRLFNEYLKANLKGEKIEIKTLSTPGQLTHKVRRWWDLDKNRDIGKFHHAVDASIVAGIATTPIGKRIVEAQNNSQFWIKEKDKVKSIPKLLEKFTMYDMKEEISKIQSDEDIFISMQVNKEANRSIANSNIYSYIKKEEEYYKIDQISDIYAPDLFKKNESLLNELFDETKTTKILLCQEKDPKLFRYLREIYYKYQDGKTNPFRNYCEELMEDKSKKFNERTDGIFTPSKNGIGVLVKKLRYMQRATDPFVLNKKTINKKENTYIGLDNVAIYCTKLYWDKDEKKILFFPIYLPVLKFDKKKGNDQHPKINDQHPLYQLYYNKLLKGKRVEHIVDLYNGNFIKIEKNKKAPTFEYVSTFDKNSGNVRCKLLNGKNGSRISSKDKFTLYDVDILGNKKKRLTWPKE

SEQ ID NO: 8740 - protein, 1096 aa, unidentified
  REGION 1..1096: note = Description of Unknown:uncultivated organism sequence
MKEKKYIIGLDLGINNVGYSVIDEESKKILKKGVRLFNTADKAEERRIARNTRRRLKRRSNRVDETLKLFKSIHFPDEITIEPDLLQKRVKGLHEKLESQEIVNIICYFMMHRGYIPFGDEERTLVELNELFPCEYYLKKWREIGKYRALEEVVNHQDLKREMIALLENQMKYYPELSQIVGNEEKGLLWIFSRKRKFWEGPGSTRSFSEYGRFKNEEDVLKYQELKKEGKEKYLFEDLIGHCKIYVNEKCAPKANYYAEEFNLINDFLNIRVINRENILKESYVHQDTSKAYHLTTDAIEAIIEYCKNFTGKILSYNKVLKDVLGLTKEDIAGYRIDKDGKPLFSLLNAYRSIKKNYEEKNLDSSWLINDLENYNRLINILAVAPGKVEIAKMLENIHKFTQEELDVIGKIQEKLKKDRFLDYHALSEKALTRAIQDMKATCLNFMQVSKKFDYEKEACEYYLKNYGTGEGTLLMTSKFIDEIVASPQVKKTLRQAIRMINAIIEEQGNYPSVIAIESAKEMNGEEKIKEIERVQKIQEKLRKDAKTILENTVSDDKVTDNMIERVILFEEIDGHCPYCGKAININDVISNTAEVEHIIPISQSADDSLENKTIACRDCNSKKKNKIPFSYMSSTEFEEFTKRVLQLNISEKKRQNLLTTDDPNKYQTRFFNRNLRDTAYATKELVTQVRLFNEYLKANLKGEKIEIKTLSTPGQLTHNVRRWWDLDKNRDIGKFHHAVDASIVAGIATTPIGKRIVEAQNNSQFWIKEKDKVKSIPKLLEKFTMYDMKEEISKIQSDEDIFISMQVNKEANRSIANSNIYSYIKKEEEYYKIDQISDIYAPDLFKKNESLLNELFDETKTTKILLCQEKDPKLFRYLREIYYKYQDGKTNPFRNYCEELMEDKSKKFNERTDGIFTPSKNGIGVLVKKLRYMQRATDPFVLNKKTINKKENTYIGLDNVAIYCTKLYWDKDEKKILFFPIYLPVLKFDKKKGNDQHPKINDQHPLYQLYYNKLLKGKRVEHIVDLYNGNFIKIEKNKKAPTFEYVSTFDKNSGNVRCKLLNGKNGSRISSKDKFTLYDVDILGNKKKRLTWPKE

SEQ ID NO: 8741 - protein, 1086 aa, unidentified
  REGION 1..1086: note = Description of Unknown:uncultivated organism sequence
MKQSNYVIGLDLGVNNVGWSIVDLDNKKIEKCGVRLFNPSDDAQTRRGARSVRRRLKRQRNRVNDSIKLFRSVGFNDKPCIDKELLFKRVKGLKEQISKQDIINIVKYFMSHRGYIPFDDEEVNFVDLDGNYPCTYYYNLLKNNGKIRAQNETVKTKDLKRELTDILNCQIKYYPKLKKISDNLINIFSRKREFWQGPGSEKSLTPFGRFKNEEDVIMYSKNKEQNSSYEKYLFEELIGKCNVLYLNEKCAPIANIYAQKFNLINDFTNITFNDISDTLNMDLFREVDNGYKLSDLGIQSIIDYCFNCDSTLKLEKMFKELFNLSIESATGYRQDKDKKVEMSTLDAYRTIIRTIKKNGYAKPKWLEDFNLYNIMMYYINVVPSSIMLIDMLKKDKEFKKYINNEDIELIKKIYETIKAKYSGYHSLSEKALVKSINDMLATGLNYQQVRKKFNYDKAFKEECAKNYVSANGSVKLSDKFIDDLIASPQVKKTLRQSIKVINAIIKEKKSLPYCISIESEKEVNGKERIKEINAEQKIREDLRKRATALIESNGYKVTEALITKVMLYEEINGYCPYCNSQKINLKDVLDNKIEVEHILPLSQSADDSYNNKTLSCRACNDSKSNKTPYDWKKSSDYEEFKKRIIDNKNFSEKKKANFLFEENLDKYSTRFINRNLRDTAYATKELINQIKMFNYYLDDKYSKTIKTLSTPGQITHKIRDNYNLAKNRDIGKFHHAVDASIVASIADTNIGEIIINSQNDEKYWLIEKTYRIDDNKKKSLARYLENVNLDKYINDIKKIDSDNKIYISSQVNKSAQGQLSDANISKIININNQLYKVSQISNIYEEDTKKLDEYFNDDSNKVHLMIKDNNPKLYNKLKDIFNQYKDQKGNPFKNYCYDRNYNEDFQEIKEFNYLKHGIKASDNPNSPMVLKLRYYSTINNPYFIEKNNINKKDKTLIALDSLKQYCTEIYYDIDHNKFAFLPVYSVSVDLNHKKINREDSYYKKMREVYLKDSTVEYITTIFNGNYISVIKKNGFIINGFYRYFHRTNNKLLLKNDEALTSSDKSFTIYDVDVLGNKKERLTYSIK

SEQ ID NO: 8742 - protein, 545 aa, unidentified
  REGION 1..545: note = Description of Unknown:uncultivated organism sequence
MKKYTIGLDLGINNVGWAKYDLETKKVIDKGVVRFKESSTAQDRRIIRGSRRLRKRKQHRVERLAIQLSNINFCTSRSYEPELLNKRIKGLNESLSEQEITNIIYWFAIHRGYIPFDEEKPEREVHKFAEDEYPCQYIFDYYKEYGVYRGQCDLISLKDNLKELKQILLTQQKYHSKLTDEVIDNILYIIQSKREFWEGPGASKENQLSPYGRYRTLEDLEKYKADSTYHQYLYEMLIGKCELSIDKDGFMDQVAPKCNFYAEEFNFYNDFINMSVKEPSQIDEEYRNKITLKGKFTKDTIEEIKKEILNTKTVSLEKLVKKVLGLELKDIQGYRIDKKYKPEISKFEFYKYLLKSFKDKKLNPHWLENDDKTIYNQIIYILTVAPSTYAIEDMLKDRVKEVEFKKEEIDVLIDIKKKKNPDLKYHSLSERILKKALDDIKRHNCEYNFMQIMKRLEYEKEMKEYFQNNYSTKTQSPYTIEDQYIDHLIANPQVKKTLRKAIKVINAIIKKEKNYPETIVIESATSLNSKERKKQIKAEQKNMIN

SEQ ID NO: 8743 - protein, 558 aa, unidentified
  REGION 1..558: note = Description of Unknown:uncultivated organism sequence
MQLLINWKETNESCIYCGESISLKEVLTTEIEHILPKSKSMDNSHNNTTCSCLKCNKEKNNRTPYQYLTSENRYEGFKNRVMNQYDKMSQDKKSNLLFEGDIDKYSIKFINRNLRDTSYASVALVQELKKYNEYLGAKEGYKINIITSPGQLTSKIRQYLKIKDKDRTYLYHHVVDAMILASIPDTEIGKVLIEAQNDSQYWFKDKNKENKYKEEVYNMLNHVWLSNRDQIQKFNQDCDNMPEDNKDGLIKRSYEVLKNPIQQFSQYTEYAKYIKQDDGYYKILQVDNIYNLLIRKKDGSVDKDKQLLDELFDLSNKKTISLLCEKKDPKLYQKLKDIYIKNASSINPFVDECKYMYGLEEGDKFNYLKQGIRKTDNPNSPLVIRLRYLKRVTNPYIKNNITTRRKNVYNEFTINKPKKDTIIGLDGLKQVSTRIFYSYDDKKFIFLPICAISFVNGKLNKKEKNYQTTYNRLIGNKNVKEIGNIYTGEWVGVYKKNGEYLEGRYKGYHKTSNVLEYYINGLDTLSCVKICSSDLRIIIYTTDILGNRHIRLDTQKEI

SEQ ID NO: 8744 - protein, 1114 aa, unidentified
  REGION 1..1114: note = Description of Unknown:uncultivated organism sequence
MGKYSIGLDLGINNVGWAIYDLEEKQIIDKGVVRYEKASGAQDRRKVRGSRRLTKRRRHRVERLAQYLYKIGFWTKRSYEPDLLQKRIKGLKEELTEQEITNILYYFSIHRGYIPFDEEKTDREVHHCGDDELPCFYIQSYYEKYKKYRGQCELILMKDNMRELETLLQNQKQYHSKINNEVIQNIMDIIRSKRQFWEGPGGAKDNQLSPYGRYATVADLEELAKDPTYHKYLYEVLIGKCELSMDNTGNMDPVAPACNYFAEEFNFYNDFINMSVKEPSNIEEEFQYKIKSNSGKFTEETIEEFKEYILNNKTINFNKMLKKILGLQEGDIQGYRIDKNRKPEFTKFEFYKYVKEQMEAKELHPDWLDDVDKVIYNKVVYVLTVAPSTYAIEDMLTDRISNISFSKPEIEILQEIKRKKNDQLKYHALSESILKKALNDIKKHHCEYNFMQIMKKLEYEKEMREYFQNHYSSKTKEPFPMEDKYIDDIIANPQVKKTLRKAMKVINAIMQQQKDYPDTIVIESAKEMNGDKAKKKIEKEQLMYEKQNEDAKKILIDEGFHVNNKNIDKVILWQETNHKCAYCGENVPLASLLQTDIEHILPKSKTMDSSLRNLTCSCPQCNKEKSNKTPYEYLSGQNKYQGFKERILKEFTNMPESKKNNLLFEGSIDKYAIKFINRNLRDTAYGTVALIEELEKYNTYLAGKIGYQINIISAPGQLTSKIRRNLDLSEKNRDYLYHHAIDAMILAGLCDTPIGQVLIKSQNDSKYWIGIKDKQHYESVYQMIAGVHLSCGKQIKEFNEACDNQPSDNKEGLLKRSYEVLKNPIRQFSDTNYAKFIKRGDTYYQICQIDNIYSYDEKKDKKLLDKLFNPDDHTVELLCYEKDKQLYHKLKQIYDSYPEEGNPFRKECIYKNGLEEGTEKFEYLLHGIHRSDDKKSPIVVKLRYMKKITNPYIKQHLSLRKKNQHSEFIDMPMKQATNIGLTSLSQVSTQILYGIEDKKFIFLPIPSICYQNGRLNTNHPYYIETYNRLVGSQKAIEFASIYCGEWVGVIKRNGEYKEGRYSTYNKNNNNLILDTNGLKSVSETYITANDQAIIIYTTDILGNRYVRLDSRKIL

SEQ ID NO: 8745 - protein, 1123 aa, unidentified
  REGION 1..1123: note = Description of Unknown:uncultivated organism sequence
MKKYTIGLDLGINNVGWAKYDLETKKVIDKGVVRFKESSTAQDRRIIRGSRRLRKRKQHRVERLAIQLSNINFCTSRSWEPELLNKRIKGLNESLSEQEITNIIYWFAIHRGYIPFDEEKPEREVHKFAEDEYPCQYIFDYYKEYGVYRGQCDLISLKDNLKELKQILLTQQKYHSKLTDHVIDNILYIIQSKREFWEGPGASKENQLSPYGRYRTLEDLEKYKADPTYHQYLYEMLIGKCELSIDKDGFMDQVAPKCNFYAEEFNFYNDFINMSVKEPSQIDEEYRNKITLKGKFTKDTIEEIKKEILNTKTVSLEKLVKKVLGLELKDIQGYRIDKKYKPEISKFEFYKYLLKSFKDKKLNPHWLENDDKTIYNQIIYILTVAPSTYAIEDMLKDRVKEVEFKKEEIDVLIDIKKKKNPDLKYHSLSERILKKALDDIKRHNCEYNFMQIMKRLEYEKEMKEYFQNNYSTKTQSPYTIEDQYIDHLIANPQVKKTLRKAIKVINAIIKKEKNYPETIVIESATSLNSKERKKQIEAEQKKYDKLNEEVKNELEANGYEATDKNMQLLINWKETNESCIYCGESISLKEVLTTEIEHILPKSKSMDNSHNNTTCSCLKCNKEKNNRTPYQYLTSENRYEGFKNRVMNQYDKMSQDKKSNLLFEGDIDKYSIKFINRNLRDTSYASVALVQELKKYNEYLGAKEGYKINIITSPGQLTSKIRQYLKIKDKDRTYLYHHVVDAMILASIPDTEIGKVLIEAQNDSQYWFKDKNKENKYKEEVYNMLNHVWLSNRDQIQKFNQDCDNMPEDNKDGLIKRSYEVLKNPIQQFSQYTEYAKYIKQDDGYYKILQVDNIYNLLIRKKDGSVDKDKQLLDELFDLSNKKTISLLCEKKDPKLYQKLKDIYIKNASSINPFVDECKYMYGLEEGDKFNYLKQGIRKTDNPNSPLVIRLRYLKRVTNPYIKNNITTRRKNVYNEFTINKPKKDTIIGLDGLKQVSTRIFYSYDDKKFIFLPICAISFVNGKLNKKEKNYQTTYNRLIGNKNVKEIGNIYTGEWVGVYKKNGEYLEGRYKGYHKTSNVLEYYINGLDTLSCVKICSSDLRIIIYTTDILGNRHIRLDTQKEI

SEQ ID NO: 8746 - protein, 1097 aa, unidentified
  REGION 1..1097: note = Description of Unknown:uncultivated organism sequence
MKKYSIGLDIGINNIGWSIVNMEEKKVEKCGIRQFSVSAGAKERREIRNSRRRLKRKDTRKKDILSLCNKIGFPNKNTIDEKLIEKRVKGLKEKLEKQDIVNILCYMVTHRGYIPFGDEEVEFVNLNNKYPCEYYYDLYKNTTNNKYRNSKLIVKNSDNIREIKKILETQKKYYKEITEEFIANIIGNEKTSGVFNRKRKFWEGPGSINSLTEFGRFKSEKDVENYLEMKKNNPNYEKYIFEDLIKKCEIEPEEKCASKLNFYAEKFNLLNDFINIGFKNIEDLTNQDCFYLHKNGMYKLNRQGLEKVFEYILDSKTVITKSLFKKLFNCDIENLSGYRIDKNRKIEISTMNGYRSIKNSFLENEGNIELINNIDDYNKIINAMTIAPGTIEVIRMINNNGIYLSQNDENSIKASYKKVKGIKYHNLSEKALKRAIDDMLKYQLNYQQVNKKLNYNKKAREIFIEEYKKVSLNKKLDNITNRFVDDIIASPQVKKSLRQSIKVINAIINEKGYYPDTIVIESTKEANGEERKKELEEIQRKKEKLKKDAKELLEKISPEQITSKNIEKVVLYEEINGQCPYCGKSLDIMQVLNGGVDIEHILPKSKTFDDSFENKTLSCSKCNSQKDNKTPMQWLQKAERKRFEDRIKSNKKISSVKKDKFLYEDDLDKYKTRFFHRNLTDTAYATKELVKQINLFNDYLKEIKKEEPIKTISTPGQLTHNIRVKYNLEKNRDEGEKPYHHAVDATILAFMPITGLGKQISNFQNNPKFFILDGKDAIMDHINNSISDYNYEKQYHKNEYDDYIKQIKEITDENKIFRSSFEVQKDCNKTLSNANILKILKKDDNYFKVEQINNIYDPNLNLKLLDKLFDDSKNITLMCQDNNKELYNKLKKIYQEYKNTNEKISIYELYCREQKGLSDEQEFNYLTDGIRSSENKNSPIVKKLRYYSPINNPYLLEKKSINKKEETLIGLDSLAQTCTQVFYNKSKNCFAFLPIYSISVDLNTRKIIKNDYYKQMYNEYIKEDEVKHIVDLYNGNYIEVTKKDGTIIKGEYKCFHKTNAVVTLKNDLYFTKQDKKLVVKDKDVIGNEKERLTFEIK

SEQ ID NO: 8747 - protein, 1097 aa, unidentified
  REGION 1..1097: note = Description of Unknown:uncultivated organism sequence
MKYIIGLDLGINNVGWSIINQETNEIEDYGVVRYQESSDAQERRRLRAARRLRNRRLHRVERLALLFKENGIPTQRTIEPELLLKRTKGLKEEIFVQDIINIIYYFAVHRGYIPFDDEKLDREVVNLEDGQFPCEYIFSEYKKNGKYRNSEKLIKCSDNIREIKKLLETQRKYHPKFTIELTDKIIEIITSKRKFYEGPGGARINQLTPYGLFRTVADLEQYKVNPNKFKYLYEKLIAKCKIALGETCAPRINYFAEEFNFFNDFINMRVKEVSLLPQIYSYKVDEKGKFIEETILEIRDYVLSNETIRLDKMFKQILGIGIDNIEGYRIDKNKKPEVSLYNFYKYVRKQFAQNGLNPIWLFDKEKVIYNKTMYVLTVVPSSVQIEEMLSERVSEYSFSPEEIKVLKEIKTKKLTNNTSLYHSLSVKVLKRALSDMKKTQYQLNYMQLMKKLDYEKEAKEFFEANYTNRTVAPYFIEKKYIDDLIANPQVKKTLRKAISVINAIIKRYKEYPTIIAIESTREMNSKAKKDAIVKEQAKLEKLRKDAITFLEENDIKVNEANILKTMCYKETNGHCMYCNNPIQASQLTTLEIEHILPISQSYDDSFDNLTVACLKCNKEKSKKTPYEFLTSINSYEPFKERVIELPISDKKKSNLLFEGDISKYELKFINRNLRDTAYGSMALVEELRKFNVFLERRANRYINLVTIPGQLTSRIRKKHELEEKDRTQLYHHAIDATIVASIANTPFGELLIKGQNDAKFWFENKEKRIELGGMLPKITLKNIENIRKINESNIKRSFEVRKSINQQISNQNPIKLVWLGNDYYKVQQINNIYEEKKNDNFIKLFDENDKKMILLCELEDPKLFKRLKEIFFSNLKANKNPFLEYCLFEHGIESTPNSFNYLIHGIKKSPKNPKSPIVKRLRYLEKRTSPYIIKKDYPNRKKNELGEFVTPKVKEKTIYGLDQLSQYCTEIYYNYETQKFIFLPIFMVSVDVNSKKINRDEHYFKETYERLIGNKKPKYIATLYNGSWCEITKKNNQTAEGRYIGYHKTNNLLTFGKDGEYSSSAPLYMSPNDKRIIIYGFNILGKKYKILDSNDII

SEQ ID NO: 8748 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKEILNLSYEDLTEEQKQLMDSVGKVLTYYKSEEKRREELSDLSLNQAQIEKLLKLNYAKFHNLSFKAMKKLMPELEAGYSYMESCLRVGYDSLSTDGVKAKYISKELLNEAVDKIMNPTVKRAVRRTVRILNEIVKLYGSPAEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSEEWLSRNLNDTRYTTKVVADLVRRHLVFEPYIDGTRKKHVYPLNGGVTARLRHEWGLEKDREKSDKHHAQDAIVIASCTEKMIQKMSNIYKLEEQGGVVRKGNKLVDRRTGEILETTALPWEWFREEVEMVIADRPEDYIERAKARGYKGNIPKPIFVSRLPVKKKTGGISENTIRAVDAASSRTVEKTSLYKLKLVEVDGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8749 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 8750 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIDVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 8751 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGFRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGNPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8752 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLTHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMIPVYYKDLYLHRMPTKAVVAHKETADWKKMDDKDFLFSLYPEDLIKVQKKNKEIENGYYKTSDRYSAGISYVQHDLGAKTYVRLCIQNLAIFEKLNVDILGNIYSCSKEERERL

SEQ ID NO: 8753 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEDRFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRGVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8754 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKVVGECTFEKGEKRACKASYISERFVLLEKINHLRICTADGNERPLNEDEKSAVIKLAYKTKVVKYNAIRKELKLDLEERFGGLTYSKVNNGDFKQRILNTEKKSDFISLKYWHEVKDILNLSYKDLTEEQKQLMDSVGKVLTYYKSEEKRREELSDLSLNQAQIEKLQKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8755 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKILKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDKLIRYGNAKDAFAEPFYKPKKDGSDGSIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8756 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFVKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKILKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDKLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8757 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKMVGECTFEKGEKRACKASYISERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKLLKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWQSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVERRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8758 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGAFKQRILDTEKKSDFISLKYWHEVKDILNLSYKDLTEEQKQLMDSVGKVLTYYKSEEKRREELSDLSLNQAQIEKLLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVHPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 8759 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSGEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 8760 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKMVGECTFEKGEKRACKASYISERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKLLKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWEKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8761 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKILKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKRIEVNGKKQIKDYYRPEDDVLLYNKLLDKLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYETSDRYSAGISYVQHDLGAKSYVRLCIQNLAIFEKLNVDILGNIYSCSKEEREWL

SEQ ID NO: 8762 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVKDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIDVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 8763 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKILKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDYVLLYNKLLDKLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8764 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLWVGYDSLSTDGVKTKYISKELLNEAVDKIMNPTVKRAVRRTVRILNEIVKLYGSPVEIHIEMARDLTHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMIPVYYKDLYLHRMPTKAVVAHKETADWKKMDDKDFLFSLYPEDLIKVQKKNKEIENGYYKTSDRYSAGISYVQHDLGAKTYVRLCIQNLAIFEKLNVDILGNIYSCSKEERERL

SEQ ID NO: 8765 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDSVKTKYISKELLNEAVDKIMNPTVKRAVRRTVRILNEIVKLYGSPVEIHIEMARDLPHSGEVKKKIATAQKNNNKEKKEAIKFISENLGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 8766 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKVVGECTFEKGEKRACKASYISYGFVLLEKINHLRICTADGNERPLNEDEKSAVIKLAYKTKVVKYNAIRKELKLDLEERFGGLTYSKVNNGDFKQRILNTEKKSDFISLKYWHEVKDILNLSYKDLTEEQKQLMDSVGKVLTYYKSEEKRREELSDLSLNQAQIEKLQKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8767 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKMVGECTFEKGEKRACKASYISERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKLLKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDKLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8768 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKMVGECTFEKGEKRACKASYISERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWEKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8769 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEDRFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIHRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRGVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGAKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8770 - protein, 1098 aa, unidentified
  REGION 1..1098: note = Description of Unknown:uncultivated organism sequence
MRKKIRYVLRLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLTHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMIPVYYKDLYLHRMPTKAVVAHKETADWKKMDDKDFLFSLYPEDLIKVQKKNKEIENGYYKTSDRYSAGISYVQHDLGAKTYVRLCIQNLAIFEKLNVDILGNIYSCSKEERERL

SEQ ID NO: 8771 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILDNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKMVGECTFEKGEKRACKASYISERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKLLKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGAKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8772 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILDNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKMVGECTFEKGEKRACKASYISERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKLLKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWEKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8773 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFRGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSGEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 8774 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIVFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKIYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8775 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKVVGECTFEKGEKRACKASYISERFVLLEKINHLRICTADGNERPLNEDEKSAVIKLAYKTKVVKYNAIRKELKLDLEERFGGLTYSKVNNGDFKQRILNTEKKSDFISLKYWHEVKDILNLSYKDLTEEQKQLMDSVGKVLTYYKSEEKRREELSDLSLNQAQIEKLQKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHEYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8776 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKIYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8777 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGDERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSVNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGITARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRAVDEASSRTVEKTSLDKLKLIAVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMIPVYYKDLYLHRMPTKAVVAHKETADWKKMDDKDFLFSLYPDDLIKVQKKNKEIENGYYKTSDRYSAGISYVQHDLGAKTYVRLCIQNLAIFEKLNVDILGNIYSCSKEEREWL

SEQ ID NO: 8778 - protein, 1098 aa, unidentified
  REGION 1..1098: note = Description of Unknown:uncultivated organism sequence
MRKKIRYVMGLDIGIASVGWAVLLLDEEDNVCGIVRAGVHTFDEVTVGKEKITATANRRGYRSGRRLVRRKAHRIQRVKSLLQEMNIVSKKDMDEYYSRAVEDVYFLRWAAIQDEPVYILNNRELAQLLIYFAKHRGYKSTAVHEQEDEDDKKVLSAISQNKKYMHEHGYRTAGEMIYKDAKFRQKRCGSSEENELLVARNSEGNYSNSISRDLLVEEVRIIFEKQRELGNTLATKELEDRFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRGVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGAKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8779 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISQNKKYMHEHGYRTAGEMIYKDDKFRQKRCGSSEENELLVARNSEGNYSNSISRDLLVEEVRIIFEKQRESGNTFATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKQSDFISLKYWHEVKDILNLSYKDLTEEQKQLMDSVGKVLTYYKSEEKRREELSDLSLNQAQIEKLLKLNYAKFHNLSFKAMKKLMPELEAGYSYMESCLRVGYDSLSRDGVKTKYISKELLNEAVDKIMNPTVKRAVRRTVRILNEIVKLYGSPVEIHIEMARDLPHSGEVKKKIATAQKNNNKEKKEAIKFISENLGKIESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 8780 - protein, 1098 aa, unidentified
  REGION 1..1098: note = Description of Unknown:uncultivated organism sequence
MRKKIRYVMGLDIGIASVGWAVLLLDEEDNVCGIVRAGVHTFDEVTVGKEKITATANRRGYRSGRRLVRRKAHRIQRVKSLLQEMNIVSKKDMDEYYSRAVEDVYFLRWAAIQDEPVYILNNRELAQLLIYFAKHRGYKSTAVHEQEDEDDKKVLSAISQNKKYMHEHGYRTAGEMIYKDDKFRQKRCGSSEENELLVARNSEGNYSNSISRDLLVEEVRIIFEKQRESGNTLATKELEERFLSIMQSQRNYDEGPGEGRQYGGNLIEKMVGECTFEKGEKRACKTSYTSERFVLLEKINHLRICTADGNERPLNEDEKSAVIKLAYKTKVVKYNAIRKELKLDLEERFGGLTYSKVNNGDFKQRILDTEKQSDFISLKYWHEVKDILNLSYKDLTEEQKQLMDSVGKVLTYYKSEEKRREELSDLSLNQAQIEKLLKLNYAKFHNLSFKAMKKLMPELEAGYSYMESCLRVGYDSLSRDGVKTKYISKELLNEAVDKIMNPTVKRAVRRTVRILNEIVKLYGSPVEIHIEMARDLPHSEEVKKKIATAQKNNNKEKKEAIKFISENFGKIESDISRKDILRYRLWKNQSQMDLYSEKLIPVEDILDYEKYEVDHIIPYSRSFNDSFNNKMLVKKKDNQDKKNHTPHEYIEHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTAQPWKWFREEVEMVMADHPEDYIERAKDRGYMGDVPKPIFVSRLPVKKKTGVISENTIRAVDEASSRTVEKTSLDKLKLIEVDGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMIPVYYKDLYLHRMPTKAVVAHKETADWKKMDDKDFLFSLYPDDLIKVQKKNKEIENGYYKTSDRYSAGISYVRHDLGAKSYVRLCIQNLAIFEKLNVDILGNIYSCSKEEREWL

SEQ ID NO: 8781 - protein, 1084 aa, unidentified
  REGION 1..1084: note = Description of Unknown:uncultivated organism sequence
MRKKIRYVIGLDIGIASVGWAALLLDENDNVCGIVRAGVHTFDEAVVGQSKITGAAYRRGYRSGRRSIRRKVNRIQRVKNLLQRLNIISKKDLEEYFSGAVENIYYLRCAAIQNEPAYILNNKELAQLLIYYAKHRGYKSNTSYEQKTDDSKKVLSALSENKKYMLEKGYQTAGEMLYRDEKFRRKRYGSSEECELLLVRNSGDDYSHSISRELLVEEVHVIFARQRELGNKLTTKELEDQFVEIMQSQRNYDEGPGEGSPYGGNLIEKMVGECTFEKGEKRACKASYTSERFVLLEKLNHLRIQSKNGDVRALTEEERDAIIKLAYKNKDVKYKALRTILKLNPDERFGGLTYSRGDIENSTEGKSVFVSLEYWYEIKKVLGLFYDDLDNEETQQLLDSIGTILTCYKSDDLRRRKFEELHLEQEKIEHLLALNYTKFQNLSFKAMKNIMPELEKGLSYTEACSNAGYGDKETIEGKNKYISKELLNNTLDSIMNPTVKRAVRRTIRILNELIKQYGSPVEVHVEMARDLTHSQTVTNKMKKRQDENKAEKEEAKRFICENFGKTEAQVSGKDILRYRLWKSQNQIDIYTNTMIPVSDILDYEKYEVDHIIPYSCSFNDSFNNKMLVRKKDNQDKKNRTPYEYIGSDEKKWEAFAACTNTYVLNYGKRKNMLTKVPASNTGEWMSRNLNDTRYTTKVVTDLIRKHLKFEAYVDQKRKKHVYPINGGITAKLRYEWGLEKDREKSDKHHAQDAVVIACCTDGMIQRLSRQYMLQEIGIVTWKNRKLLDRRTGEIIEETNLPWKCFREEVEMFMADSPEDYIEKAKKNGYKGEVPKPIFVSRLPQKKTTGEINKETLRCVRIDSKGKMRFVNKTKLPDLKLVEVDGKKQIKDYYRPEDDKLLYDKLLACLVKNDDAKVTFAEPFYKPKKDGSDGPIVKSVKTYGKPADDLVAVGKGLAERGKIYRCDIFRKNGKYYMIPVYFRDLYAGTLPMRAVRAKEKEVDEKDYIFSLYPDDLIKISKNGREYYGYYKTCDRTNAAIKYKSHDSSSSEYIVTGIQKLDLFEKKSIDILGNIYKRNKEEREWN

SEQ ID NO: 8782 - protein, 1177 aa, unidentified
  REGION 1..1177: note = Description of Unknown:uncultivated organism sequence
MEYRLGIDLGSSSLGWCCLKLQDGKVVGILDMGVRIFPDGRNDKTKDPLCVARREARGSRVRLNRFKQRQKQLIIDLQESGLLPQSMEEFKALENLNPYELRANAVRKQVSLYELGRALFHLNQRRGFLSNRKEERDKKGNTKTQQAMDNLQMLISEKACATLGEYMYEVEEHRRFKNSTDANGKLKINWYPNRQMYKDEFTVIWDKQKEFYPDILTDKLKNKIENDIFFQRPLKKQQTGFCWLEPEQKRSPRSYNIAQQFRIMSEIANIRIGYPHDRELNKPEREALFEFLNNAPADSFDKDHYVSWEKILEVLHLDKDVVLNLMRQDKTGLLCNITNALLGNDKVFGDKWYSFSDDLQNQIIDILQDYSLQDGEAETKLKELNLGFDQSQIDNSLENSLSLPDGYTNLSAKAMRKLLEDMKLCGSDYATAVENVYHQTAADVGFFEERDELPPYQELFTESLIGGDKELYDKELDYDNYMGRITNVSVHIALNQLRAVVNELIKKYGKPSGITIELGRELTKGKKALAEIDKKQKESAKIMEEARAEIRKAGATVTSFNIEKYKVWHNLNEDITKRIDLYTGKNISVSQLFSNEYEIEHILPYSWTYDDSYNNKIITRANINRQKSNQLPYVFFSDERQLKAVAKDDEELKEMSIDNVIRRAKEIDKSRKNIKKTFNFNALTWRFSKNARDIFNRNNKNMARDLTDMQYMSKLAKKYLTCICPPNKIVSAKGQMTDLLKAIWELSDVSPEDYRLWTPQEWQKRDITEWKKKQFILTNPEWNADEAEKEAKKFVQGLTDEEIHNMTHVGKNRTVHYHHALDAFVLANITTKVMQEMSTEAFANAVEEYAEAHNVTIREAQKSLLTQSSDISYKPYSTFDKENLSHMLRDVVISYKNPIDKLKSIIKKAEITGQNLAHFSFAPICEDTAFGFKKIIKISKNDIDIEFSVRKDGKKKVETHKLSTMVPVFRTKEQKQSFLDLYVQWQRAVMRQKFIGKGKYEEIEKAFIETFTRDKAFKWFASAGNYGAQIYQIQKNDKFAPNKNEDWSLEILPNYYAFERKGKFFWKDIYPTAKLITTLKINDVIEATFERNDNLESGFSKIRNWVKEQFENHPDKEQLQLLFRVKKMSGGSIFLRPLHIAQEDNGDVKSWQCTIGKFKQYQCRKVCITPTGKVLRG

SEQ ID NO: 8783 - protein, 1194 aa, unidentified
  REGION 1..1194: note = Description of Unknown:uncultivated organism sequence
MSCCYRLGLDLGTSSLGWCCLDISNNEDRKILDMGVRIFPDGRTDKEKTPLCVSRREARSSRTRLRRFKMRQSKLIKDLQNIGLLPADKKLFKELEQVNPYELRAKAVKEKLSLFELGRVIFHLNQRRGFLNNRKEEKDAIKDEKLKSKKETKTQTAMNKLTDLMKAENCQTLGEFMFKTGKKRFKNPVDDKGKLQIEFYPNREMYAEEFEKIWNFQKQYYPNILTDEHKQIIENEDIFYQRNLKKQDAGYCSLEREEKRAPKAYVISQRFRIISELNNLKITYPSEGMLSEEERNKLLDFLDNPKEKFDNSIVKFERILELLNLPIETSFNLMENNREGIKYNETNAILGSDDSFGSQWFEFSQEQQDAIIDILQDYSLDNKEVLEKLKEKCPKLSAEQINNILNNSLFLPDGYSNLSEKAMNKLYDEMFAKYDIAYEKAVENVYGKNIDELMSFEQFDFLPPYQELFPEQLKGGEKTLDKNLFYDDYMGRISNVSVHIALNQLRIIVNELIKKYGKPTEITIELGRDLTKGKKALADIAKRQRENAKIMEEARQAIRQQGVRITPFNIEKYKVWRNINPKNVLKRVDLYTGKTISLTDLFRGSYDIEHILPYSWTYDDSYDNKIITRSDVNRKKLNQLPYDFFTDENQLKSLAKNDEDFADMQLDEIKKRAKDIDKARNNIKRTFNFKAISWRFSEHAREIFNRNNKNMARDLSDMQYMSVLAKKYLTCICPKEKIISAKGILTDLMKNVWNITDTLPHDYELWQVQKWQRDDLIEKKIRQITNENPDMEDSLIQEKAKETVSAMSENEIQKQTSPKKDRSIHYHHALDAFTLANITTSIVQYVSSSKFANEVENFRNEKNENPDSEKQIDMKEAQLRLLKQSGKFYEKPYPSFNKEEFSKQLENIIVSYKNPVDKLKSVMKKSKILHKNMENFSFSSIHKAGAFGFREIVSIKNGDMEIKLAQKKDKKVKYDTKSLSCMIPIFRTKEQKRAFLEKYVEWQKACVRRKFITKEDYLQIEKEFIATFTKDKAFKWHESDGNYAAQIYQINKNDKFVPNRNENWSVEILSNYYAFERKGRFFWKDIYPTAKLIATLRINDIVEATFDKEDQLDKGFTQNKKWVNHQFELNPNVQQLQLLFRVKKMTGGSIYLRPLHVAQEDADKKSWICSVGKFKDYHCHKVCVTATGKVLNGN

SEQ ID NO: 8784 - protein, 1194 aa, unidentified
  REGION 1..1194: note = Description of Unknown:uncultivated organism sequence
MSCRYRLGLDLGTSSLGWCCLDISNNEDRKILDMGVRIFPDGRTDKEKTPLCVSRREARGSRTRLRRFKMRQSKLIEDLQKIGLLPVDKNLFKDLEQANPYELRARAVKEKLSLFELGRVIFHLNQRRGFLNNRKEEKDAIKDEKLQSKKETKTQTAMNRLTDLMKSENCKTLGEFMFKTGKKRFKNPVDDNGKLQIDFYPNREMYIDEFEKIWNFQKQYYPNILTDEHKQIIENEDIFYQRNLKKQDAGYCSLERDEKRAPKAYVISQRFRIISELNNLKITYPSEGMLSEEERNKLLDFLDNPKEKFDNGIVKFERILELLNLPIETSFNLMKNNREGIKYNETNAILGSDDSFGSQWFEFSQEQQDAIIDILQDYSLDDKEVLEKLKEICPKLSAEQINNILNNSLFLPDGYSNLSEKAMNKLYDEMFAKYDIAYEKAIENVYGKNIDELMSFEQFDFLPPYQELFPEQLKGGDKTLDKNLFYDDYMGRISNVSVHIALNQLRIIVNELIKKYGKPTEITIELGRDLTKGKKALADIAKRQRENAKIMDEARHAIRQQGVRITPFNIEKYKVWRNINPKNVLKRVDLYTGKTISLTDLFHGSYDIEHILPYSWTYDDSYDNKIITRSDVNRKKLNQLPYDFFTDENQLKSLAKNDEDFANMQLMEIKKRAKDIDKARGNIKKTFNFKAISWRFSEHAREIFNRNNKNMARDLGDMQYMSVLAKKYLTCICPKEKIISAKGILTDLMKNVWNITDTLPHDYELWQVQKWQRDDLIEKKVRQITNENPDMEDSLIQEKAKETVSAMSENEIQKQTSPKKDRSIHYHHALDAFTLANITTSIVQYVSSSKFANEVENFKNEKNENPDGEKQIDMKEAQLRLLKQSGKFYEKPYPSFNKEEFSKQLENIIVSYKNPVDKLKSVMKKSKILHKNMENFSFSSIHKAGAFGFREIVSIKNGDMEIKFAQKKDKKVKYDTKSLSCMIPIFRTKEQKRAFLEKYVEWQKACVRRKFITKEDYLQIEKEFIATFTKDKAFKWHESDGNYAAQIYQINKNDKFVPNRNENWSVEILSNYYAFERKGRFFWKDIYPTAKLITTLRINDIVEATFDKEDQLDKGFTQNKKWVNHQFELNPNVQQLQLLFRVKKMTGGSIYLRPLHVAQEDADKKSWICSVGKFKDYHCHKVAVTATGKVLNGN

SEQ ID NO: 8785 - protein, 1194 aa, unidentified
  REGION 1..1194: note = Description of Unknown:uncultivated organism sequence
MNCRYRLGLDLGTSSLGWCCLDISNNEDRKILDMGVRIFPDGRTDKEKTPLCVSRREARGSRTRLRRFKMRQSKLIEDLQKIGLLPVDKNLFKDLEQANPYELRARAVKEKLSLFELGRVIFHLNQRRGFLNNRKEEKDAIKDEKLQSKKETKTQTAMNRLTDLMKSENCKTLGEFMFKTGKKRFKNPVDDNGKLQIDFYPNREMYIDEFEKIWNFQKQYYPNILTDEHKQIIENEDIFYQRNLKKQDAGYCSLEREEKRAPKAYVISQRFRIISELNNLKITYPSEGMLSEEERNKLLDFLDNPKEKFDNGIVKFERILELLNLPIETSFNLMKNNREGIKYNETNAILGSDDSFGSQWFEFSQEQQDAIIDILQDYSLDDKEVLEKLKEICPKLSAEQINNILNNSLFLPDGYSNLSEKAMNKLYDEMFAKYDIAYEKAIENVYGKNIDELMSFEQFDFLPPYQELFPEQLKGGDKTLDKNLFYDDYMGRISNVSVHIALNQLRIIVNELIKKYGKPTEITIELGRDLTKGKKALADIAKRQRENAKIMDEARHAIRQQGVRITPFNIEKYKVWRNINPKNVLKRLDLYTGKTISLTDLFHGSYDIEHILPYSWTYDDSYDNKIITRSDVNRKKLNQLPYDFFTDESQLKSLAKNSEDLANMQLMEIKKRAKDIDKARGNIKKTFNFKAISWRFSEHAREIFNRNNKNMARDLGDMQYMSVLAKKYLTCICPKEKIISAKGILTDLMKNVWNITDTLPRDYELWQVQKWQRDDLIEKKVRQITNENPDMEDSLIQEKAKETVSAMSENEIQKQTSPKKDRSIHYHHALDAFTLANITTSIVQYVSSSKFANEVENFKNEKNENPDSEKQIDMKEAQLRLLKQSGKFYEKPYPSFNKEEFSKQLENIIVSYKNPVDKLKSVMKKSKILHKNMENFSFSSIHKAGAFGFREIVSIKNGDMEIKFAQKKDKKVKYDTKSLSCMIPIFRTKEQKRAFLEKYVEWQKACVRRKFITKEDYLQIEKEFIATFTKDKAFKWHESDGNYAAQIYQINKNDKFVPNRNENWSVEILSNYYAFERKGRFFWKDIYPTAKLITTLRINDIVEATFDKEDQLDKGFTQNKKWVNHQFELNPNVQQLQLLFRVKKMTGGSIYLRPLHVAQEDADKKSWICSVGKFKDYHCHKVAVTATGKVLNGN

SEQ ID NO: 8786 - protein, 1111 aa, unidentified
  REGION 1..1111: note = Description of Unknown:uncultivated organism sequence
MKVLGLDIGTNSIGWSLIDDIKEEIIAMGVRIFPVGVNEDKYNKSHTEESKNKARRDARSARRRRFRQKMRRATLKKILESWGIPSEIKSTNIEAYQLRAEAIDEKVSLADLGLIFLHLNKRRGFKSTRKDEILQEGDEDLGIKADKEAGKVKIGIEKLQTDIENARCRTMGEYFYSLIRQSSEQEKYAYNPQMPVERIRGRYTSRKLYEEEFDTIWQKQKEFYPELLNAENYRNIKERCIFFQRKLKSQKHLINKCNFEKDKPCCPTSKPIYQEFRIWQKINDLIVSTAITEEGRPLTKGEKQILFEELQNKPQLKASEIKKLLFAKPKSVEMNFDDKDSIKGNITRVKLIKALGEAYVNKLSAEKLDQIWHYLHIQQDSEKFTAKQWLKKTALEKLQLTEQQAFAFTKINLEDDYGSLCSKAISKILPHLKEGYQYSEACKRAGYHHSIDAEKANRTLKDSVRELKANELRNPIVQRSLTEMRRLVNEVIRLYGKPDVVRVETARELRKPKEEREKILNKNRDKDALRKEYADFLSQKLGRQISPRSSEITKYELWLELGADAKDLADKGGNMDEFVKFSRKVSTGDKTKFNLWKECMRRSVYTGEIISLSDLFKSEIEVEHIIPYSKSMDNGFANKTLAERKFNQDKGGRTPHEYIVGTLGKEAWNVFCERIKIFPKHKQDKLKMQEYPEADFLEQQLRNTAYIAIKAGEMLEEVAKVELVKGQSTAQLRTHWGLNGTLNMENPEIKNRGDHRHHAVDAVVIALTTKSLLKTLSEWNIYNQQRDLLQIDEKYLPKQMWGGKLRKQLDKHLESMLISHRADNRLIVRKKGRIFTKKEKIKTKTTLAVRGALHEETFYGKIIFPHKNHPYFKEGDAIYVVRKKLSAFKEVKELREIIDLKVLDVLKQRVETFGGKVKDAFKGAEQGEVKMYSPTGKDVAIRKVRIGRNFSEPILLRPKENKKLFVESGSNYVLGIYENPVSKERKFKVIKFFDAVRLKAASKPVLPNSLDDFRLIYTLKKGEMFVMVEEHEDEILNMDKKALFKNLYKVIKFSQGKIYLGLHCVAKLGDDDESNDKEQENDRVKVRIYRNALKFRAVKVKIDILGRISIA

SEQ ID NO: 8787 - protein, 1280 aa, unidentified
  REGION 1..1280: note = Description of Unknown:uncultivated organism sequence
MAKFILGLDIGTNSIGWVLFRDNKIFDKGVIIFPIGTNVDKNGIETTKNMERGLYRRASRTNFRYKLRRKDLKKFLASLDMLPAFSNTFEVKENYQASEIYKLRAIALDDKIPVEELGRIFLLINKHRGFKSNSKTLSEAKDEDGKVKGEISELAKSMEKYNVRTIGEYFHKMYQKAASLYKDGKWHNIDEPFDERSLMDEDNNFSLINSRGIRREGRFIGREMYATEFDLIWDNQKKYYPQLTGSKKEYDEICKLPVEEKRNKLKIFKETYYWKIKHQIIFFQRPLKSQKKFIGKCQFENNKRTAPASSLVFQEFRIWKQLADIRYTDKANDIYNQPLPPQWKQKIFDYLQTNLSLSLRPKKDNSDILALLGITNKKDFEFNYDSNEDDKTFQGNKTLYAIYTACGEDKFNQLKAENKLEKLWHILYMAKDDEWLYDTLTWKWQFEPSVATKIIEMGLEEGFANYSSKVIGKILPFLKEGKDEHDALILANYIQASDEYKETYVLQKKIKQLRNNELRNPVVEKAVGETIRLVNTILKSNDIDQEDFAIIVESTREFKKPKKEREGIRRKNLDTEKRREEYAKFLNEKKEKGELNFSRYIQKNDSIINKFELWLELGADKNDPEFKEFEKIVERRDREKYTLWLDCNRICPYTGNVISLSKLFSPEIEIEHIIPYSWSLDDSFTNKTLTFSYVNKEKANKSAYEYMQSKGKDAFKSFKERVKVFNKEKANEKFLNEKPEQTFTNAQGRNASYIAVYVRKKLQEVCRDVQFTNGFATGELRKNDWRLGSLLDKVRYQEETGIDIDKYTREFANYKRDFEQYRKRKANSTDIAKTDWRSLTQEMTTEYEAETQNPIYEWWEELQKFDAFRGAKGKKDRSDHRHHLLDAIIIGMCSRSIIQRLSTLNQLREKQGVSLYDEKGELTRERIDLPIPYSEIKEALQSVLIYHKAEQRLITAKQNRIHKKKHSKTDSAIIKQRTIAPRGSLVGDNFYGKLKTPQRQGFTKSDVYIKRVALNGDNFKDKKSLEKVYDKNIKKILELRLDKYGDKGEKAFSEEALLKDPIFAYSTKEYPNGLPISPLSKKGNTLPVIKKVRVANKNSRNLIQLVAKDEQKNIVNANRYSEADGNYVMALYESKEVDKKGKEKIKRDFEIVSFFKAVERRRKGEKLFPDEKEQKDGTFLPLMKSCPYLKAGDFVVMYENEASEIDWDVKEDLMKRLYKVTELGLNPTGDGYAVIKLVKHNLMKTVKDSYLKNGPFLKRSESINAIKVIIDRLGNIKPAI

SEQ ID NO: 8788 - protein, 1102 aa, unidentified
  REGION 1..1102: note = Description of Unknown:uncultivated organism sequence
MVFIVISSRHESSYYLVQLQIPYEMSHTLGLDIGTNSIGWCLVEDGKGIVAMGSRIFPVGVKEDSYAKSGTEESRNAARRTARGIRRGYARYKLRRTELEQLLTANGMMFDKTVSLPTKQLYSLRRDALDRKLELEELGRIFFLMNQRRGFKSNRKEQAKGDEEKKLTATKQAMRDFEARMHAAGCRTAGEYLATLFDDLPENWHNENEPKERIRERQRVRRELYQQEFDLIWEKQQQYHPQVLTPELKHQLRDRVIFFQRKLKSAKHLVSKCRFEPAKHVVPRSHPLFQEFRILQALSNIRITDRDRVNDLLTMEERDALAVQLGQAEKVNVSLIKEWLDYPRSARINDLGDLRGHTTWSRIRKAVGDDWFEEQSKEARLKLWHTLYFAADEGWIEEYAQRALGMNDEQAKRFAEVNLELDYGSISHKAAQKILPFMREGYDFAGACEQAGYHHSQNELDNPARELKDKLTGADIDELRNPLVQMTVNETARLVSAVIKQHGRPDMVRVELLRDLKKPKAKRETMRRDMLAKEKQRDAYRDFLKEKGIISNPYPSDIKKFELWLELEYSESDVTRLSPDMDLKAFKKFAEAVKPADKEKYRLWLECERISPYTGKAIPLSALFTEAYHVEHILPYSRSLDDSFANKTLCEDAVNTEKGNLTPLEYYEQKRTADELKAFKQRVKNFSEGKLAKFLATEVKDDFLNSQFTNSAYIGTEVRKLLRKAFKDVRVTNGQLTGLLRNKVWNLNTLLNTADGQKNRDDHRHHALDALVIACTTQSLVNRISRESQFDFRGVQRVPDVGLPWNTFRVDAAEKLNAMLVSYKGGKRLLTTKTNKYRHSMAHEGKPEKWQRTKAVRGPLHEETLYGRITLQHKGSKEETYVVRKALTSLTKPEQLENIVDPVVRKTVQDHVAKHGSLKEALKMPVYMPVKKENESKLVPIKKVRLRTNAEELVELRPGTYVEPGNNYCIAIYEDRRGKRDFRTINFLEASKRALHKQPIYPSELDGKQLLMTLQQKDLVILYDEHQDEIQWHDPNWLANHLYMVKSFDRIGAIRMVLHKRSNANPNFPKLYPAGTTYTKKVSSFRGVPVAVDALGQITKVQ

SEQ ID NO: 8789 - protein, 1314 aa, unidentified
  REGION 1..1314: note = Description of Unknown:uncultivated organism sequence
MEKNILGLDIGTNSIGWALVSPEKAEITKQGVCIFPMGIDEKTKVSKNKARRDSRMVRHNNHHYKLRREQLINYLKEIGFPEIAKNEGKKQITYLQKDQNAYDVYRLRKEALERKLSLEELGRVFYHLNQRRGFLGSLKDQESTETDPAKRKKQEEELEGLKKKIELLEDKVEQNFPTLGAYFYDLLQNRKVDFDAKTAIKTDKNAEIVLDQTVRRTYTSRKLYEKEFDLIWEKQREFYPQILTEEARKKIKLDIIYYQRKPYKSNRGLLGKCSLEKNSVVALKSALEEQESRIWQIVSNNLKITDFENNRIEDALSLEEKTLIVNELNQKKSLKISQIYSLFTKNKTWSKEAFFKGYEPTTEIRGNSTAVAFRKLLGEERYAILKGEYDQAKTHSDLQKTMLFKLWHALLYAHNGKNIKEGEWLFSFAKKMLFTDEQAKMYSKIRLEDGHGSLSIKALRKILPYLKQGYKFYESCEMAGYHEKDLEAETETLPTKMSAPKNHELRNPVAQKAVGEAIKLINVLLKKYEKTHKIDEIRLETTRELKKSAAKGKEMQSQNEKISQIRKNHADFLSKNSVQIFGFPRILDPKIKRDMNEIRKYELWLELGTEDGTLSKFAYENKFSIFLPSQEKEKKKEKPKNEEARAKQEKAEAWLAEKIEKYDLWKECNRISVYTGRVIPLSDLFSDSVIDIEHIVPYSKSMDDSFSNKTICESRFNRETKKDRLPYDCYDKAEWKAFKQRAKYFPERKRENLLRESLPEDFFNSQLSDTAIIVKEMRKVLAKTKIKVSLTSGTFTSLLARYWGLYGLLDSAKELKNRGDHRTHSLDAVVIACSGEAQKIVEKCDRDGKKWAMFVDTDDKENGQKVTVRKLKIVVDIPLPYAHFREDLGKMLNNILVYHRSKNLLLSKRSAKFGKKNTTSQKSETFGKSENLEKVKKHIFTGVRGALHEASVFGKIDFPHDKNRQGKGFSANETAFVKRVLLAQIQPTTFLKLIGEAKEKEGAEEENDENSEGKGVKTEIVDLKIREALRLHYWECGKDVKKALATTAYMPDVNNKGWRMPIKKVRLAERIGKPITLYKDTPREQYVKSGNNYIVGVYQEGKDFEIEKVFFFDAVQRKLKKEPLLPAQKEKEKRLSTLKKGDKLFWGKELLKLSLKNSKELAKLLDIFRHTDLPFWFQEAQSEKQFLVKEINEKGVLYIKTLPLVQTFKKGDMVYRFGKTTAESTVQKPEDINWNDQEAISDRLYRVQKITDGSIYITKHYIAKFPQGKEAWERKINNDANKKFALRLQCGYGSLDMIAVEIDILGNIKVKKAK

SEQ ID NO: 8790 - protein, 1110 aa, unidentified
  REGION 1..1110: note = Description of Unknown:uncultivated organism sequence
MKVLGLDIGTNSIGWGLIDNEKQEIIATGVRIFPIGVNVSTQFKEESKNKSRRDARSARRRRFRQKMRRTALKKILDSLAIPSKIKSTNIEAYQLRAKAIDEKVGLADLGLIFLHLNKRRGFKSTRKDEILQEGDEDLGIKADKEAGKVKVSIEKLQTDIRNADCRTMGEYFYSLIKQSSEQEKYAYNPQMPIERIRGRYTSRKLYEEEFDTIWQKQKEFYPNLLNAENYKSIKEDCIFFQRELKSQKHLINKCRFEKDKPCCPTSKPIYQEFRIWQKINDLVVSTAITDEGRPLTKGEKQILFEELQSKPSLKASEIKKLLFAKPKAVEMNFDDKDSIKGNITRVKLIKALGEEYVNALSSEKLDQVWHYLHIQKDKTWLKKIALEKLQFTEQQAFTFAKINLEDDYSSLCTKAMGKILPHLKEGYQYSEACKKAGYHHSLDTEKANRPLEDSLKKLEANELRNPIVQRSLTEMKRLVNEVIRLYGKPDMVRVETARELRKPKEEREKMHNKNRDKDALRKEYADFLSQKLDRQISPRSSEITKYELWLELGADAEDLAKKGGNMEEFVKFSRRVSTGDKTKFNLWKECLRRSVYTGEIISLSDLFKSETEVEHIIPYSKSMDNGFANKTLAERKFNQDKGERTPYEYIFNTLGKEAWNAFCERIKIFPKHKQDKLKMQEYPPADFLEQQLRNTAYIAVKAGEMLTKVVNVELVKGQSTAQLRAHWGLNGTLKGENPEIKNRGDHRHHAVDAIVIALTTKSLLDTLSKWSAYNPQRDLYQIDEKYLPKQMWNGKLRTQLDKHLGSMLISHRADNRLIVRKKGRIFTKSKGLIKTKTTFAVRGALHNDTYLGYIKFPNDKHPYFKKGQLVAKVRKPIDLLSDTEIENIIDPKVKEQVKKYFAEKEQEGKQKTKEQKIIEAKMYSKKGYDVPLKRVTVAKTDKPIPLYPNRENTPYVMPNDNYIMGVYEAEVINKGKPQTKRMDIVVSFMESIQRKTNNLPVLQPIIQEGEQTYKLIYTLKKGDMFVMYENHTDEISWHDDKDLFKRLYKVIEISSGTIYFGLHYAAKTSADRSKDKNEKKEQSIVRIFRSPSKLKAVKVKIDILGRISMA

SEQ ID NO: 8791 - protein, 1288 aa, unidentified
  REGION 1..1288: note = Description of Unknown:uncultivated organism sequence
MARFILGLDIGTNSIGWVLFKDNKIFDKGVIIFPIGTNIDKNGIETTKNKERGTYRRVSRTNFRYKLRRKNLKNLLVSLDMLPTFSNTFEVKENYQASDLYKLRAKALDDKIPIDELGRIFLLINKHRGFKSNSKTLTEAKEEDGKVKGEISELTISMKKNNARTIGEYFHKMYQKAANLYNDGKWHNLDEPFDERALIDEEGNFSLLNSRGIRREGRFVDREMYATEFDLIWDKQQKYYPQLTGSRKEFDEICKLPVDEKRASLKLFRESFYWKIKHQTIFYQRPLKSQKKFIGKCQFEKNKRTAPASSLLFQEFRIWKQLADIRYTDKANDAYNQPLPREWKLKVFDYLQTHLSLSLRPKKDNSDILELLGIANKKNFEFNYDSNEDDKTFQGNKTLYAIYTTCGEDKFNQLKEENKLEKLWHILYMAKDDEWLYDTLTWKWKFEPSVATKLVEMGLEEGFANYSSKVLAKILPFLKEGKDEHDALILSNYIKAPDKYKETQALQKKIKPLHNNELRNPVVEKAVGETIRLVNAILKSHEIDQEDFTIRVESTREFKKPKKERESIRRKNLDTEKRREEYAKFLNEKKEKGELTFSRHIQKNDSIINKFELWLELGADKNDPEFKEFEKIVERRDREKHSLWLDCNRVCPYTGNTITLSKLFSSEIEIEHIIPYSWSLDDSFTNKTLTFNYVNKEKANRSAYDYMQSKGKDAFNEFKERVKVFQKEKAEGKFLNAKPEQTFTNAQGRNASYIAVYVRKKLQEVCRDVQFTNGFATSELRKNDWRLGNLLDKVRYQEETGIDVDKYTREFVNYKRDFEQYRKRKANSTDIAKTDWRNLTKEMTAEYEAETKNPIYDWWEELQKFDAFRGAKGKKDRSDHRHHLLDAIIIGMCSLSIIQKLSTLNQLREKQGISLYDEKGELTRERIDLPIPYLEIKEALESVLIYHKAEQHLITSKQNRIHKKKHSETDSKVIKQRTTAPRGSLVGDNFYGKLKTPHLQGFTKSDVYVKRVPLNGENFKDKKNLEKVYDKNIKKILELRLNKYEGKGEKAFSEEALLKDPIYVYSTKEYPNGIPNNPSSKEGNTLPVIKKVRVANKNSRNLIQLVARDEQKNIVNTNRYSEADGNYVMALYESKEVDKKGKVKIKRDFEIVSFFKAVERSRNGEKLFADEKEQKDGTFLPLMKSCPHLKAGDFVVMYENEPEEINWESKKDLMKRIYKVTQLSSKIVSKIYEFGDLFFTKHNISSSNAKYESKGYSNIKEYKYLQNSHIQLKAIKVQIDRLGNISKA

SEQ ID NO: 8792 - protein, 1123 aa, unidentified
  REGION 1..1123: note = Description of Unknown:uncultivated organism sequence
MGNILGLDIGTNSIGWAIVNVEKKTIYTNVHVFPQGVTEKTGVPRNIQRRAARGARRNNFRYKQRRSRLKNLLSQAKMLPQSTEKHPYTVYELRAKALDKPIQLEELGRVLLHLNQRRGFQSNRKEQANADKDKEKELGKVKEGIKELESLLQEKNSRTVGELYWQLLQQRKHDFTADQAVRNRFPTEKRFTSRELLKAEFEKIWEKQRQFYPQILTDELKKEIGEKTIFYQRKIKTQKGTIARCPFEPNSSCIPKAAIEFQEFRIWQSLANIKVSIPDKNRISDELTLEEKQKIAYELDRLTNKDMRLTFKQIKTLFKKEWGKEVYFNYRDDDHIKGNTTAIKLRRVLGEKYDEIYQQYNEAFEYEEKRKTLFYKMWHALLYADNNKWLKKYAIEKLGFAEDQAEEYAAQNLEEGNGSLSYKAIRPILAYLKIGENYTNACNLAGYDHALLPDKHRKLLPKIDKLKNNELRNPTVQRALTETIKLVNRLLKEYTIDAIYVETARELKKTKEKRDEIEKELKAKTENRRKLAAFLSEKYQLLFGVRREFDLNNKSDMEDIRKYELWLELAPADKELHELGLKKGFAGFNFIQKASKEDLEKYVLWREAQRISIYTGKVIPLQRLFSKDYEIEHILPYSRSFDDSIKNKTICEAWFNADKRNLTPYEYFQNKSKEEWIAFKHRIQILPKEKKERLLRQKEIDGFRNSQMTDTAYITREITKRLQTVCRDVQTTQGAVTSMLRGYWGLNSLLNTTGNNEKDRNDHRHHALDAIVIACTNRAKVQLINWANAKDIDWRKQRKKIDLPWSNFRYDVQQKLHAILVSYRQDNGILIKRRAVIKTKNGKKKTGIQIGIRGELHEATYYGKHILPKGAPPAKDKKTKTAYFVRKKLSSLTENEVKQIVDKVVRETVQKAIEEKGFKKALAEPIYMPDTRNKGWQMPIKKVRISVNKDDDTMIPLYKKEADQDYPRNLYVPSGSNYIMGIYQDPRSGEKEVYIASFYEAVQRKIKKLPVLEPMLGNKKLVLTARQGDMFVIYENHPDEIEKHINWDCIDHQARRFLFDRLYRVRKMDKSSGRLYLAQHHLAKVDLDRDPFPLKIYPNGKNFNGIPVEIDILGNIKRKKAYN

SEQ ID NO: 8793 - protein, 1034 aa, unidentified
  REGION 1..1034: note = Description of Unknown:uncultivated organism sequence
MSGFIIGLDLGVASIGSCVILNKRIDSAAVSIFPEGVNVSPLGKESSRNTTRREKRQIRRQLFRKNKRRKLLNEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKSGYNKFRRFLKKSIDADMVSRQLNDTAWLAVEARRYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKAGKYVDSGNNHHIVIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNELGEIRPA

SEQ ID NO: 8794 - protein, 875 aa, unidentified
  REGION 1..875: note = Description of Unknown:uncultivated organism sequence
MHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNRGKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKSGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGEHFEAAEINWNNVSNEELSPYLYRVQKLTSGGVTFRHHLTSVLKNDSNVEIGRAIKTPNSFNGIKVTVNELGEIRPA

SEQ ID NO: 8795 - protein, 1315 aa, unidentified
  REGION 1..1315: note = Description of Unknown:uncultivated organism sequence
MAKILGLDLGTNSIGWAVIDDEQKEILGVGSRIFSEGVNIDSKNQSETSKNKVRRGARGARRLNYRFKLRRKKLKTILKEIGLFPDNKFYTNKKGNKKEHTIELYKLRKDALEKEIRKENLGRIFLQINNHRGFLSNKKEEGEAILNDEKNENLGTVIKAIKGLQGKIDLAYNKNKIKHPYIGSYYYYLIEQNKDSFNPNEPIERIRGEKHYTLREMFEKEFDAIWEFQSQYHSELTPENKKRIKDETIFYQRDLRSQKHLRNKCIYKYKTYYKKDKEKNYIKDKNGDFIEVKKYLDCAPKSSFEFQEFRIWEQLNKLQYKIKGNNYYEELKDNQKNILANKLDTLIQIKLSGKIEEKDKLYLNQLIIELGINKQARFNQNRLIGNVTKAKLIEALGKDFWNKLYPKEGSADNEPIKYSNEQRTLWHNIYFSSNFIKHIDWLKGEQKSNGPVLRKNRKKQIQNTTWQKTVKKIGLNDEQLEKYSRIAFEPDICSYSTKALKELLSYMKQGYNPTKAATELGYESASDIRNNNSQLEYKIPPLKNNELRNAVVQRGVTEAIKIINTIIEEKDDRGQLKYGKPDEIRIELSRELRKSKDVRQKMHQRNEDKRKEREKYAEILSEIKGIQIDPSSDLIRKFELYLELDFSKQSIDDIKQFIDIKVFNTFCKNIDIRDHEKYKLWKECKRVDPYENRPISLSQLLSSVIEIEHIVPFSKSHDNSFLNKTLAFRDFNAKKLNKTPLEYFETLGKEEGKFLKQIKKFSKEKRKRFLLKSDEIEGFKNNQLNNNAYIATELKKHLWNSFPSNKVNVTNGVSTSIVRRLLGFNSILNPSFIVRQELENGKYWVRIDDSDNIIEYKKIKKEDKTPSSEKNIKIIEGYISYNEQKQTRYFYPKKSRDDHRHHTVDAITIALINTKINQIIANNSIIADADIKRIEKLSGKAKEDEYQKLNKFNEYGQFKKEVIEKIRDEIYKELRGFYNLRGNAVNFVKNTLVSHRFDQRITASSKKKVYKNGKPLNKNDKQVYSGGDVAQGSLHEAYFYGKTKDCSDGEFVRRIKVEDLSSNQIELIVDEKIKNIIKDGIKKYDDFKKAIKEGFFLKNEGKRKKRLNEYDENIPRKPVPIRKVRIKYKSKMIPLRPSENPKLFAIPGDNYLMAIYQQDTDKPNSKRDFELVNFFDAVAISKKSSEKKYGKLDLYTPISQKNNFPLYQVIKKGDMVLLYESSAEEEIKWDDNEDLFMRLYQITGLNISPNNYGRIYLMKHNDARKSSDLGTPITGAFKFGDNKIKRMLYHTQFNALIEGKDFKISTTGKITKIGK

SEQ ID NO: 8796 - protein, 1028 aa, unidentified
  REGION 1..1028: note = Description of Unknown:uncultivated organism sequence
MGYTLGLDLGPTSIGWALLDFKEEYIIDAGVRIFEEGVENMDQKQEMSKNASRREKRQIRRQTWRRKKRRRQLRSKLWELDMMPKDDLDDFFAMNPYPLREKALYEKLTPYEIGRIFYHLNERRGYKSNRIESLSDKEEGAIYDGSDKSGARGISELRKAIAEGGFKTLGEYLNSLNPHDIRIRNRYTERDMFVEEFDSIWEIQKQFYPELLNDENYKDIRDRIIFYQRPLKSQKNRRGYCKFEKNKRRAARFHPTVEEFVMHQQLNSIRVIGGDRIDDDRQKLTNREREILLKELETKGQVTFKKMRKLLQLNGKEYKINVESQEKIDGLKFYSKLKKAIGKDFDKYDDEELFKMWNTLHFAKEPEWLLDYARKTWGFEGDKLEKFCKIKFPKTYAKLSLKAIRNILPYLKEGLIYSDAAERAGYDHSLLEEKPEILEKLPTPENVANPLVNQTLHQLKKVVNEIIDVYGKPEEIRVEMARDLKLSREHRLKILIENRAREKEADEIKKILTKEGLVDVPTRNDIKKYKLWVECNETCPYTGKKIGLHQLYNGEVDIEHIIPYSRSLDSSFNNLSLCFREENEIKGNKTPYEAYGGDTERFEEMKYRLKDTKMQKPKVDRFLAKKLDPNEFISRKLNDTRYISKVAKNYMKHLTENVNVATGQTTATLRRFWGLNAILARDNEDEDLKNREDHRHHAVDAIAIAATSRAALKRLSDAHSAYGMKEEKLVRHFPPPWEGFYIDVEYALQKIIVSRRVNRKVRGQMHEDTFYGMLKDNLGNQKQNKNGVPLYTVRKPIENMKAKQIRNIIDEKVKDAIYERLYEFGVDVYRENKNNFGLSSAEFNKKRNEAFAEPVFLNGIKSGKKTPIKKARIEVASSNMFKISGYNKWVEPGSNHHVEIYADEDGTQKGEVVTLFEAYRRKREGEPIIKTNHGPNKEFVCSLQINEAVLWGEVPEAFDPEDKATYGAVFDKVFRVQKSSKAQMNFRTHNTAITNDYDRRCLLQKSPSKFFGTKILISPAGFIEYADD

SEQ ID NO: 8797 - protein, 1085 aa, unidentified
  REGION 1..1085: note = Description of Unknown:uncultivated organism sequence
MSRTLGLDIGTNSIGWALIEDKKEIIRSGVRIFPVGVQEEDFLKNGSEVSKNIARRMARGARRRRFRFKLRRKQLNKLLQANSMLPDVEEFFSTRELYELRVNGLDEKLSLTQFGRILLMLNKRRGFKSNRKSAADPKKKKEEGIVIEEISKLQQQINDSGLRTLGEYFYSLFKKADNEKQWPNEHTPIERIRDRFVGREMYEKEFNLLWATQAKYYPRVLMPELKTEIGSETIYYQRNLKSQKGLVGKCRFEPSKRCAQRSSLEFQEYRIWQQIWMVRFESGERIGQELTVEEKQKVCAALMKQHKMTETETKKLLDIPRTDKMNDVFGSKGILGNRTIADLIDALGVEMYDRLTDAQRFEFWHILTYTDNTDKLKEIVRNKVAQNIIPKLTDEQLDAYSELNLEEGFGNLSKKALDKILPHLRTGLPLTEAIIKAGYDPTKRIIKGKVVELTKIPPLASNELRNPIVQQMLSETFRVVNAIIKDYGKPEMVRIELARELKKPKKKREEARGNAIRKRKQREDYAEFLTKRLKKHIEPNSIEVKKYELWLEMGCADDNLDNLDSFIRNGRITDAIKYRLWMECGRISPYSGKVISLSKLFSPEIQIEHILPYSQTMNNEFGNLCLCEVEINMKKGDRLPAEYFESIGQLDKFKSNVARLQNEGKRRRFLSKEIPEDFLNSQLVNTSYAGRELAWRLSTVFPPIEKGEKESPRIQVVNGYATSDLRRLWALNSILSKGDIDTKNRGDHRHHAIDAITIACTTPKIMHTLSSSSKFNTRGLLTNDEIKEPWKRFLDDSAESIKSIIISYRNQKRLVGTKPNKIKSKDKEKYPKGYMIRNAKTIRGALHEETLYGSIQQNEEQRFVTRWPISKFTEEKQLDKIVDPKVREILKKRVKKYSSLKKAFEPNDKDPILMYSKKGVQVPIRHVRVINPGEHLEEVRPGVFVEPGNNYTIAIYQDPETKKRSFETISFYSAVQRSLQNEPIVKETFDGRPLLYALKQRDIVVRYDEGPDEIDWSDMEYLRKRLFRVRKFDVKGIVYLDYLYASKLNDKEDRNTLFFQLSPNTLNCVHIELDALGNIIRKEGV

SEQ ID NO: 8798 - protein, 1374 aa, unidentified
  REGION 1..1374: note = Description of Unknown:uncultivated organism sequence
MAKFILGLDIGTNSIGWVLFQDNKVFDKGVIIFPIGTNVDKNGIETTKNMQRGIYRRTSRNHSRYKLRRKDLKRLLAILHIIPSFTNTFKIKKKYQASELYQLRANALDKQIPIEEIGRIFLLINKHRGFKSNSKTLSENKDEEGVVKEDIRNLSTAMKANEARTLGEYFHKMYEKSAQSFNDGNWHNIDEPFDERAIDNDGIFWLQNNRGIRREGRFVGREMYANEFDLIWDEQKKYYPQLTGSKMEYDEICKLPVEAKRNQLKLFKATCYWKIRQETIFFQRPLKSQKKFIGKCQFEKNKRTAPASSLLFQEFRIWKQLADIRYTDKENDIYNQPLPHEWKQKIVDYLETNLSLNLREGRKKEDGTRNKDVLDILGFINKKNFDFNYDTNEEDKNFHGNKTLYAIYKSCGEEKYKQLKAENKLGKLWHILYMAKDDEWLKDTLTWKWKFDEPIATRLIEMGLEEGFANYSSKVIEKILPFMKNGNDEHNALILANYIQAPDEYEEIAVLSKKIKQLANNELRNPVVEKAVGETIRLVNTILKTHNIDQEDFTIRVESTRGFKKPKKERENIRRKNLDTEKRREEYAKFLNEKKSKGELNFSRDIKKNDSIINKFELWLELGADKNDPEFKDFEKIVERKDREKHTLWLDCNRICPYTGIIIPLSKLFSAEIEIEHIIPYSWSLDDSFTNKTLTFNYINKEKANKSAYEYMKNKGEAEFKAFKNRVKSFGKEKADEKFLNQNPERTFTNAQGRNASYIAVYVRKKLQEVCRDVQFTNGFATGELRKNDWRLGNLLDKVRYEEETGIDVDKYTREFANYKRDYETYRKQKANSTDIVKTDWRNLTPEITEEYEAETKNPIYEWWQELQKFDAFRGAKGKKDRSDHRHHLLDAMVIAMCSPSIIQRLSTLSQLREKQGATLYDEKGELTRERIDLPIPYSEIKKSLESVLVYHKAEQRLITAKQNRIHKKKHSADDTNVSKQRTIAPRGSLVGDNFYGKLKKPQHQGFAKDAVFVKRVSVNGENFKDKKALDKIVDKNLRKILELRLDKYGDKGEKAFSEEALLEDPLFVYSTSKYPNGLPNNPVSKKETPLPVIKKIRVANKNSRNLIQLAAKDEEKNIVNSNRYSEADGNYVMALYESKETDKKGKVKIKRDFEIVSFFKSVERRRIGEKLYADEKEQKDGTFLPLMKSCPFLKAGDFVVMYENEESEINWDAKKDLMQKLYFIAELNRQVNVDKQTGKENEFGVIKLNKHNNQKTTNNSYITEGPFIKILHTGLKVVKVNIDSLGNITPIKTQNPYLFSKEENNNNTISESETNYQKKTIQSFSSLKESNEANAKQMAAIPPIDHLKNVITLVKQVYKEELKEPMDKKLNFE

SEQ ID NO: 8799 - protein, 1307 aa, unidentified
  REGION 1..1307: note = Description of Unknown:uncultivated organism sequence
MKHIIGLDIGTNSVGWTLVKELDDKNIDILNTGVHIFPIGTIVDDKSGKEKTKNEQRREYRGSNRMLFRYKLRRKNLKNILSSINMLPDFSKYYKVKNKKQSFLIYEFRAKAIDTKIPLDELGRIFLLINKHRGFQSNSKKIKTEDEESGKVKEGIAQLERYMHISNSRTIGEYFYKMHCKAKDLYNQNKWHNDNEPIDERAINENGEIVLFNSNGIRRHYGRYTLRDMYKYEFDRIWSKQKEYYSDILTGSPEEYQKIRKLPHKEKIESLKEFRRTLYWQIREYCIFYQRPLKSQKKYVSNCQFEKSKKVIPASHPLFQEFRIYKQLSDIRYRDEENNKHRLKKEWIDELAKYLKFTDKIYLKSSKNTKDKNLPTFSSVLNLPDNSIEFIQDIPNSDSFVYGNRTITSIFESIGQEKFKNLERNNKIESLWHHLYISKDGLMKEDEWLLGILTEKSKWDLNIEQAKELIYNGLEDDYGSYSSKVIKKILPFMRNSDDEYTALLKTGYLKSPDEVSEDIPLKEKISQLKYQELRNPVVERAVSQTIKIINSILDNYKEEINKDNFEIRIESTREFKKPRNEREKIRRDNLDKDKIREEYARFLNSKKEELGLKRKIEKYDPLINKFELWLEMGMDDNDGRFNENDFKIFDKVTKPGDKLKHNLWLECNRICPYSNRVISLSKLFTSEIEIEHIIPLSRSLDDSYINKTLTFSNINNEKGKRTSYEYMKNNIKEFKKRIESSNFSESKIEQFLRKEVNSEFSNDQISNTSYIAKYIRQKIQEVCRNVRFTNGFATSELRVNDWKLSNLLDKIRYEEETGNNVDEIYENYYLIKKEFNSWFEKKYKSTDFKIDWSNIDKNIEIKYFQDETKSDFLYWWTKLNEFNQFRNKAGKKDRGDHRHHAVDSLIIACCSPTIIKTLSTYNAAREEIGVSLYDEFGNITRNKIEKNFNYFQLKEKIFNIIVSHYEKQILIKKRVNHVKTKNGIIKFNTYAPQGNLHAESFYGKRNNDFVRRIKLFDDKRQDKMLFEELKDLNNQGKGEKWHYIPEDSLYSAIKNRIEKLGKKALSKEMMEKEPFHMVSSKYPDEIVSKKNKPLPIIKSVRYKFNFKRSIINMPIKDENGNIISKNRFVNNERNYIMVFYRNSSGKKKFAQPISFFESVKRKQKCEKLIPDEIEYKDEIYGLDKSLPWIKIGDIVFLYKKGENIDEINWEDKNLLSKRLFKIKSISSSEVKSNKKVYEYGYIYLLNIKRAKDSGYKSQNNIEKAIKLPSFKLSHDKFDAIKVRLNSLGEIIAKGEECFIKNEYLIDE

SEQ ID NO: 8800 - protein, 1299 aa, unidentified
  REGION 1..1299: note = Description of Unknown:uncultivated organism sequence
MEHTIGLDIGTNSIGWVLLKTDQILDKGVNIFPIGTNLIKGVQEETKNHQRGMYRRAKRNLFRYKLRRKELRKKLKELGMIPDFLKLNKVKNQYQASDLYKLRADALYGKIPIDEIGRIFLLINKHRGFKSNSKVLAQKTDEEGIVKEGINQLQSFMKESQAKTLGEYFHKMYERSKSIYEEKKWHNIDEPYDERAASKDGDLVLHNSRGIRRENGRYVARAMYEREFDLIWEEQKKHYPQLTGSRTEYDEICRLPIEQKRTALKVFKTTAYWGVKHETIFFQRPLKSQKKFIGKCQYEKNKRTAPSSSLLFQEFRIRKQLSDVRYSDVENEIRKQPLPYEWKIQLYNYLKINRKLNLREGNKKKDGTKNADVMDVLGLQNKKRYKFNFDNGDDDKVFEGNQTLYAIYTACGVDLFNELEKQNRLEKLWHLIYMAKDDEWLKDTLLSNWILDPDIVKNEEIVNKLVEMGLEEGFGNYSSKVLKNILPFMRDGKDEYDAKVLANYEKAPDEVKDEEPLKAQISQLKNNELRNPVVERAVAQTIKLVNTIIGNGTYNIDQEHLTIRIESTREFKKPKTEREKIRRGNSEKEKKREEYAKFLNEKRQEGKLSFVREIYKNDSIIGKFELWLELGGDKDEPSFKEFEKVAERKDREKHALWLECNRICPYTGKVISLSKLFSSDVEIEHIIPYSRSLDDSFANKTVTFCEVNKEKGDKTAYEYLKGKGERIFNEFKSRIKVFGKEKEENKFLLDKVPTEFSNAQITNTSYIAKYVRKKLQEVCWDVQFTNGSATGELRKNDWRLGNVLDKIRYEEETGIDIDDYFREIGLYKKDFEVWRSKKANSTDVLKTDWRNITPETTLEYEMQTKNPLYEWWQKIQDFETFRGGRGKKDRSDHRHHLLDAIITACCSRSIVQQLSTLNQTRERQGYSMYDGKGNLTRRKIECPLKYEQIKEALRGNLIYHKSDQKLITSKVNRIKISKEKGGLVKQKTFAVRGSLVGDNFYGKLKNPRHQGFDRDIVYVKRVTLNGENFKDKNGLDKIVDSNVKKILQRRLESSKYAGKGEKAFSEEAMKNDPVYLYSVKKYPNGIPENPVNKDGNMLPVIKKVRVANKNSRNLIQLAAKSDERDSAGKRIILNKNRYAEADGNYVMALYEKKQFDAKGRKKKSLREFEIVSLFESVRRKSEGKRLFSDEKNGIGLMESCPYLIIGDMVVMYEEDESEINWEDLDSLQKRLYRVSGMSSEEKYGILSFVKHDKTSQNASYGKAAYKYGSNQISFASRHTQLNIVKVSITQLGKIERLHG

SEQ ID NO: 8801 - protein, 1034 aa, unidentified
  REGION 1..1034: note = Description of Unknown:uncultivated organism sequence
MSGFIIGLDLGVASIGSCAILNKRIDSAAVSIFPEGVNVSPLGKESSRNTTRREKRQIRRQLFRKNKRRKLLTEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLREDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNESGEIRPA

SEQ ID NO: 8802 - protein, 1034 aa, unidentified
  REGION 1..1034: note = Description of Unknown:uncultivated organism sequence
MSGFIIGLDLGVASIGSCVVLNKRIDSAAVSIFPEGVNVSPLGKESSRNTTRREKRQIRRQLFRKNKRRKLLTEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNESGEIRPA

SEQ ID NO: 8803 - protein, 1034 aa, unidentified
  REGION 1..1034: note = Description of Unknown:uncultivated organism sequence
MSGFIIGLDLGVASIGSCVVLNKRIDSAAVSIFPEGVNVSPLGKESSRNTTRREKRQIRRQLFRKNKRRKLLTEILQSLGWFPEHILDVNKLMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNRGKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGEHFEAAEINWNNVSNEELSPYLYRVQKLTSGGVTFRHHLTSVLKNDSNVEIGRAIKTPNSFNGIKVTVNELGEIRPA

SEQ ID NO: 8804 - protein, 1034 aa, unidentified
  REGION 1..1034: note = Description of Unknown:uncultivated organism sequence
MSGFIIGLDLGIASIGSCVVLNKRIDSAAVSIFPEGVNVSPLGKESSRNTTRREKRQIRRQLFRKNKRRKLLNEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNESGEIRPA

SEQ ID NO: 8805 - protein, 1034 aa, unidentified
  REGION 1..1034: note = Description of Unknown:uncultivated organism sequence
MSGFIIGLDLGIASIGSCVVLNKRIDSAAVSIFPEGVNVSPLGKESSRNTTRREKRQIRRQLFRKNKRRKLLNEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARRYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKAGKYVDSGNNHHIVIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNESGEIRPA

SEQ ID NO: 8806 - protein, 1034 aa, unidentified
  REGION 1..1034: note = Description of Unknown:uncultivated organism sequence
MSGFIVGLDLGVASIGSCVVLNKRIDSAAVSIFPEGVNVSPLGKESSRNTTRREKRQIRRQLFRKNKRRKLLTEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNVKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDGWLTNYGKQKWGLTAAETDKLLKVSLEKDYAELSQTAMKKLVPLMKSGGLDYTDAAKKAGYEHGLNTKKETLSDILGEPQNLRNPIVQQGLFELRKTVNAIIKDYGVKPDKIRIEFARELKMPKKKREGLSNANKNREKERDEIRNILFDEFNIKEPSRTDILKYQLWLETNRQCLYTGEFIGKEELFSPNIEIEHIEPLSRSLNDSQSNKTLSIKRFNNLKGNDLPFEMMEKGKITTSEYDEIVERAKILVRKGGYNKFKRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGGHFEAAEINWNNVSNEELSPYLYRVQKLTSGGVTFRHHLTSVLKNDSNVEIGRAIKTPNSFNGIKVTVNELGEIRPA

SEQ ID NO: 8807 - protein, 1034 aa, unidentified
  REGION 1..1034: note = Description of Unknown:uncultivated organism sequence
MSGFIIGLDLGVASIGSCVVLNKRIDSAAVSIFPEGVNVSPLGKESSRNTTRREKRQIRRQLFRKNKRRKLLTEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNRGKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSDNNHHIVIFSKPDGKKDGIVVSLFEVAQRKRNKQPIYQTDVGEENTFLMTLQINELVLLNGEHFEAAEINWNNVSNEELSPYLYRVQKLTSGGVTFRHHLTSVLKNDSNVEIGRAIKTPNSFNGIKVTVNELGEIRPA

SEQ ID NO: 8808 - protein, 1034 aa, unidentified
  REGION 1..1034: note = Description of Unknown:uncultivated organism sequence
MSGFIIGLDLGIASIGSCVVLNKRIDSAAVSIFPEGVNVSPLGKESSRNTTRREKRQIRRQLFRKNKRRKLLTEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGEHFEAAEINWNNVSNEELSPYLYRVQKLTSGGVTFRHHLTSVLKNDSNVEIGRAIKTPNSFNGIKVTVNELGEIRPA

SEQ ID NO: 8809 - protein, 1034 aa, unidentified
  REGION 1..1034: note = Description of Unknown:uncultivated organism sequence
MSGFIIGLDLGVASIGSCVVLNKRIDSAAVSIFPEGVNVSPLGKESSRNTTRREKRQIRRQLFRKNKRRKLLTEILQSLGWFPEHILDVNELMQLDPYPLRAKGVSNALTREEFGRVLFHLSKRRGFKSSRKSGGTEEGVLFEGDKTGTKKGIAELQEEMHKNGFKTVGQYLAALNPHEVRIRNRYLLRKDLVDEYELLWETQLKFHPEWKKPDNFEEIIQKHFNIKYHDKLLESDLPTFLRDYVIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARKYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKTGKYVDSGNNHHIVIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNELGEIRPA

SEQ ID NO: 8810 - protein, 790 aa, unidentified
  REGION 1..790: note = Description of Unknown:uncultivated organism sequence
MIYYQRKLKSQKGLVSPCKLEPKAKRAPASCLLFQEFRILQKLHDIRLIGKGKTNESLTQKQVENAFEWLNISPDKNFKQLKKELKISDDELNFKETDKIKGNRTAYELSKVFGKLVWNSFSEKEQFNRWRILYDAEDDDWLTNYGKQKWGLTAAETDKLLKVSLEKDYAELSQTAMKKLVPLMKSGGLDYTDAAKKAGYDHGLNTKKETLSDILGEPQNLRNPIVQQGLFELRKTVNAIIKDYGAKPDKIRIEFARELKMPKKKREGLSNANKNREKERDEIRNILFDEFNIKEPSRTDILKYQLWLETNKQCLYTGEFIGKEELFSPNIEIEHIEPLSRSLNDSQSNKTLSIKRFNNLKGNDLPFEMMEKGKITTSEYDEIVERAKILVRKGGYNKFRRFLKKSIDADMVSRQLNDTAWLAVEARRYLQTICPNVEVIAGQATAELRHLWGLNRILNRHGLDIKNRDDHRHHAVDAVVVACTDIGMIQQLSKLHEKGRKATNERFPPPWEGFRNDVKDAVNQILIKHKVRSRVRGQLHDETIYGPVKGFQQQQLTNERGLPVFKSRKELTALSEAMIDKIGDKKIKEIVKNRIREHGVEPTGKFKIPANAFSEPLYLPTKKGGKIPIRRVRIHDVATSKIKLKAGKYVDSGNNHHIVIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNESGEIRPA

SEQ ID NO: 8811 - protein, 1083 aa, unidentified
  REGION 1..1083: note = Description of Unknown:uncultivated organism sequence
MPTTLGLDLGTNSIGWALVEDGKRIIRSGVRIFPVGVQEEDFLKNGTEVSKNIARRMARGARRRRFRYKLRRDKLCKLLTTNNMLPDDHDFFSTRGLYELRVIGLDKKLTLKQFGRILLMLNKRRGFKSNRKAAADPEKKKEEGVVKEGIAELQKHIEETGFRTVGEYFFFLFTQADKEKGWPNEYTPIERIRKRFVGRDMYRHEFNLLWKKQSEYYPEVLTDELQKKIADETIFYQRNLKSQKGLVGKCRFEPSKHCTQKSTLEFQEYRIWQQLWMVRFSTGDRIGQELTVEEKQKVCAVMMKQHKITEAEMKKVLGIPKTEHFNDVFGAKGMLGNRTNSDLIKVIGEEMYEQLTDRQKFEFWHILTYTDNDEKLKVIIRRKIEKKILPSLTEQQVEAYAEINLEEGFSNLSKKSLAKILPHLRKGLPLNEAVIAAGYDPYKKAVVGKLQEVNKIPALQPNELRNPIVQQMLSETFRVVNAIIEEYGKPDKVRIELARELKKPKKIREKIRNANIRKRKQREEYAEFLTKRLKNHVAPNSIEVRKYELWLEMGCEDPELDKLDEFIKRGRKIDPLKYRLWMECGRISVYSGKIIPLSKLFSPEIEIEHILPYSKTMNNEFGNLCLCERSINERKGKMLPIQYFESIRKLDDFKKNVARLQNDAKRRRFLTKEIPDDFLNSQLTNTSYAAQELAWRLSTVFPPLINEDKGSPRIQVVNGQAISDLRRLWALNSILSKGDIDTKNRGDHRHHAIDAIVIACTTPKLMKTLASASKFDRRGQLTCETIKEPWKKFLTDSAVSIGSIIVSYRNQKRLVGKKPNWIKIKDKANHQKGLLRQNTITIRGQMHEETLYGSIKSYDEQTYVTRWPLTKFTEDRQLDKVVDHKVREVLMKRVKKYGGIKKAFEENKNDPVLMYSKKKKIIPIRHVRVFNPGEHLEEIRENVFVEPGNNYAIAIYEDPETKKRAFETISFYTAVKRSLNNKPIINSNLDNKPLLFALKQRDIVIRYDSGPDEIDWEDMKYLRSRLFRVRKFDVVGQIFIDYLYASKINKEDRNTLFFQLRINTANIIKVEVDLLGRILNKMD

SEQ ID NO: 8812 - protein, 1078 aa, unidentified
  REGION 1..1078: note = Description of Unknown:uncultivated organism sequence
MSRTLGLDIGTNSLGWCLVEDGQGIVAMGSRIFPVGVKEDSYAKSGTEESRNAARRTARGIRRGYARYKLRRTELEQLLTTNGMMFDKTVSLPTKQLYGLRRDALDRKLELEELGRIFFLMNQRRGFKSNRKEQAKGGEEKNLTVTKQAMRDFEAKMQAAGCRTAGEYLATLFDDLPENWHNKNEPKERIRERQRVRRELYQQEFDLIWEKQQQYHPQVLTPELKHQLRDRVIFFQRKLKSAKHLVGKCRFEPAKHVMPRSHPLFQEFRILQALSNIRITDRDRVNDLLTLEERDALAVQLGQAEKVNVSLIKEWLDYPRSARINDLGDLRGHTTWSRIRKAVGDDWFEEQSKEARLKLWHTLYFAADEGWIEEYAQRALGMNDEQAKRFAEVNLELDYGNISHKAAQKILPFMREGYDFAGACEQAGYHHSQNELDNPDRELKDKLTGADIDELRNPLVQMTVNETARLVSAVIKEHGKPDLVRVELLRDLKKPKAVREGMRNAMRNKEKQRDEYRDFLKEKGIISNPYPSDIKKFELWLELEYSESDVARLAPDMDLKVFKKFAEAVKPADKEKYRLWLECERISPYTGKAIPLSALFTEAYHVEHILPYSRSLDDSFANKTLCEDTVNTEKGNLTPLEYYEQKRTPDELKAFKQRVKNFSEGKLAKFLATEVKDDFLNSQFTNSAYIGTEVRKLLRKAFKDVRVTNGQLTGLLRNKVWNLNTLLNTADGQKNRDDHRHHALDALVIACTSQSLVNRISRESQFDFRGVQRVPDVGLPWHNFRVDAAEKLNAMLVSYKGGKRLLTTKTNKYRHSKAHEGRPEKWQRTKAVRGPLHEETLYGRITLQHKGSKEEAYVVRKALTSLTKAEQLENIVDPMVRKTVQDHVAKHGSLKEALKTPVYMPVKQQNEGKLVPIRKVRMRVNSAEMLELRPRTFVEPGNNYCIAIYEDAKGKRAFRTVSFFDAVQRAKRKEPLYPAEVEGKKHLMTLQQRDLVVLYDKHPDQIQWNSPNWMAEHVYSIRSLDRKGEVHMVLHKAGNASSGNAAQKAAAIYLRRKVGGLTVVPITVDPLGTLVRRK

SEQ ID NO: 8813 - protein, 1096 aa, unidentified
  REGION 1..1096: note = Description of Unknown:uncultivated organism sequence
MPTLKNNKINRKKMALPKWAEAKSLQNNLYSELLSPQIYDKLLNVMKKILGIDLGTNSLGWALIEENTKLIDGGVIIFPRGNQQDPKSGKETSFAQNRTIFRGARRLLFRRKLRRQRLLELAKKYFNLSPEDIYTDTDPNTIYRLRSEGLERLLTEKELFRICLYFAKKRGFLSNRKDEARSSEADKGKVNQSIAELNSSIIENGCTTLGQYYYKLISDHRNGLRLDERILERYTSRKMYLDELDFIINFQINNKSTFLTPEIAAELKKQVFYQRPLKSAKHLIGKCRLESTKRCMPKSHPIYQEFRAWTIINNLRWTNHDTGESEGLTLDQKNKAFTYFNTELKLTETKLKKILGISNRAKFNDVELKPCRTIIEMQTIFSESKIEISENQFKSIYHSLLFTQDSQFENFKNYLLSKYKISNEIADKLWKVHLEPDYGNISHKAALKLLHYMRQGMRYDEACLEAGYHHSFENKFKNYDKVRELKTNELRNPVVQKAIATCINLVNKIIDNYGKPDEVRIELARELKKPKSVRENIRFKNLNKQKQRDKYREILEKHFNRTIANSESLLTKYELWLELGCEELGLGGFDEFVKNSRKVDLEKYNLWLEADRISPYRGKVISLSRLMSPEIQIEHILPYSRTLDNSFMNKTLCESHFNANLKGKYTPMEYFSKRPQEEQNDFLKRIYLFSNPAKRDVFLADSLPDSFTNNQLTDTAYIAKLAIQRISQCIEKVYPTKGGATSIIRRELGLNSILHYGDDINVANDIKNRGDHRHHFIDAVVIAATTTAQLQQLSRANTINGKIDVDITAPWNSFRSDIEEKANSLLVVHKVNHKLTRKSINTYKHGSKATKNQELTAIRGSLHEDSLYGKIINSKTGEENYVIRKDLKSLDEKQLEKIIDEGIKRFLKAEIEKLGSWANVIKSPIIYNGKPIRKVRWQNTAKSLNLLREETKTYTEPGNNYVLAIYEDVNGKRDYESVSFYDAINKVISGKLVYPKSKQNKNLKYTVKILDKFIIYSESPEEINWTDFTSLNSRLYHLKKFTGSTVYISKSTIANEDSKVYKMPASKQSSVNTFSAIKIKLNLLGQIIWRSDIGKV

SEQ ID NO: 8814 - protein, 1025 aa, unidentified
  REGION 1..1025: note = Description of Unknown:uncultivated organism sequence
MKKILGIDLGTNSLGWALVAENEALLDGGVIIFPKGNNEDPKTGKESSYSQLRTQYRGARRRLYRRKLRRRRVLEIAQKFFGLTESEIFKDSNPFTLYKLRYEGLERILQPDELFRVCLYFAKKRGFLSNRKDLMKENNKDLGTVKKGISELEELIKNSGSRTLGEYYFQLISDHFKGARLEERILERWTSRKMYEDEIDKIFSTQFNLKSPFINPELASELKKQILYQRPLKSAKNLVGKCRLESSKRCMPRSHPVFQEFRAWQNINNLKWANPDTSEFGELSIDQKMLLIELLKSDLKPTEAKIKKALGFSSRIKFSEIELVPCRTEIQINKILQDEGIELSNDSILSIYHCLLFTGDTHFDKLAEHLKTKFNLERAIAEKLWSADHLKLEQDYSNISHKAAQQLLPFLRKGMRYDEACIEAGYHHSFENKFKDLPLVRSLKTNELRNPVVQKAVSVCIALVNQLIGKHGKPDEVRIELARELKKPKAVREQIRFKNILKQTKRDHYREVLENHFGRTIAYSDSILIKYELWLELGCTGNDFDDFDAFTKEVKKTDLEKYRLWLEADRISPYSGKVISLSNLISNQEIEIEHILPFSRSLDNSFANKTLCERSINSFKTNLTPLEYFERRPEKEKSDFQKRIARFSNPFKKSMFLTENLPDSFSNSQLSDTAYIARKSVEKLSECIEKVYTTKGGVTHMVRKDLGLNSILHYEGTPDLIAEMKNRGDHRHHFIDAVVIAATSQSLIQKISRATEFGNGNLKLNLDPPWPRFRSDLEDMVNGILIVHKFPKKLVRSSINKYKHDNRPDKKQLIQKSLRGPLHEDTLYGKITNPFTGEENYVVTKRIINLNEAQLDKIVDEKIKEYLKNLIEKNGSWAQLIKEPIYFNGKPLRRVRSLNKAPNLPLLRPETKTYIEQGNNYSMIIYEGEGGKRDYLSLSFYNAINNKKELGQLYPNILENKNLKFSLTHYDKFILYSAHQEEIDWSNKEELFNKLYHVLSFTGNSLYLGKSNLSNIKSNIVLTPN

SEQ ID NO: 8815 - protein, 1199 aa, unidentified
  REGION 1..1199: note = Description of Unknown:uncultivated organism sequence
MKNKKLSISIDMGAKNNGVFTAKTNGDNIEEKKAFNVVIDKDINFSKKSRRENRHRVRNYKRRKLAKRLLWDILDKNKFKDNQEQINGLLNNRGYTFLSTSSEFEELQDETVEFISEFLPEIKELKTKEDFEAKLSEFELKELKDFIDKTTQNLDIEYKKKKDEFHKEFQTKHSIIKKDLKVIKEFLNDILKEVETGSKPRKKYLQEINEEIQSFDFIDNKEEFFNLVGNISNLQLRILRKFFDGAKRKKDSYKLLKDYFNFFHWNYNDKEKKQKNELFSELKKYDNLEEFFKNCDPLLTIPPYEDMNNRDTYKCYSLLINPKYITDSLKKSIDILWSQKEFEVLHSDNLKYPQKLQRILDISYKMIDKQIHPREVFKKDKGDIGFYQKLLKENFKEFSCFAKEYYILEQKAISGIFKAGLLIKCDKNTPSKNNFKHILLKPLYKYDFTKVKVEKFYEKIKNTKGLQSHLKRVSEVAKDYQNSFYHYIEACYENDKCLNDKRIKDIVKNIDSDLKAFQNIFDSLNIKTYLNKIEKIDKDNLKRVINIFKQTYEILFKDINGFSKTCKTCTIENNYRSSGDIAIAKRLLSDVAKPIDGMLDFMLDKIAFEIVEQIDSIEDEVEIILEQNRFNFEDNLALVKGKKPKKREAKDILNLNICPYSGESITNINGEYDHILPQSKELFNSKANLIYCSSKGNREKSNKRYYLKNLNKKHLKEIFKTDSLDEIKNIIKENIKKIDIDKFTNFENLSLKEQIALRYALFCDENSNEFEKAKEIIKKDKLKTITNGTQKRLARLIFEKIKQKFKKEIDCNVKVIDNLLISATRKDLSYDKTTGEINELWKEKNQDSHSHCIDAMVAFYLANSSIKGNYHKKRDNLASIEPDFEFGNIYIQKQNSSEIKIKKTNIKEKILQNKKMTSIGNTEVLFRENMLSNHYLNIFKIDNKFYYGESKKQILDFNGFNQNMLDYLLKQNILKEFGNNYFAINKAMFYEVLFKQKNEVLKNYKLFKKLDELRYTTQKKSIVSLIDKFLNPSTNDEKKFIKTLVGDNKITKIDQFNYENLIKYFQKGNKLEHKKIKLKISKAYEIIAKELSQNSNSFLTQKDKKFFLNNQALINLLKESILFQKTFKTKRKITNKYSLPLKDTTDKPFLIRRKDNNAKNIYQVVFAKNSARGFVGDIYIHKNHKNIIPLKMEDYKKAF

SEQ ID NO: 8816 - protein, 1095 aa, unidentified
  REGION 1..1095: note = Description of Unknown:uncultivated organism sequence
MKKLSIALDMGAKYNGVFITKVDDDKIIDKKAKCIVIDKNAINFSKVSRRANRHKVRNIKRRKLAKRLLWEILEKDHFTKEQQELIQGLLNNRGYTYLSTSSEFELLQDESVEFIKVYFENLKDLKTKDDFLEFLSDEKFSDEKALLGFLDKQIEKLEIEHKKKKSDFYKAFQEHHSIIKSDLKILKEFFINIQKEINTGSKPRTKYFKEIKEEIEKYDFIEDKESFFNLIGNISNLQLRVLRKYFNDKFDHRFDDEKLYKKLNDYFKRFHDRDFETKIFKMFNTTKSSKEFLEKCSPTLTIPPYEDMNNRNSYKCNSMLIRDNLITEALKKSVDRLLKKSAFEILEQDGLTYAQKLQRILDINSKIVPLTVYPRNVFKHQKNNSDIKWYQDILQDDFNEFSQFAKRYYREEEKILNGIYDDSFLFRKCNTNTPYKNNIKHILLKQIYSYEFTKDEADKFLEDIKSIRGLQTSLKRVSEEAKNYQNSFYHIIEACFNNEECIEDKNIKTIIKNLDKNLSDLKTILQGKDTYLTTIDGVNSKNLKRVINIFKQTYEILFDNLSGFNKTCRNCTQENAIRSDEKCVIAKRLLSDVAKPIDGMLDMMLDRIAWEIVKNISKDDIEDVWNIEIVLEQNRFEFEENLIEIKKSSNSQIKQKKREYKDRLNVNVCPYTGKKFEKGDWDHILPRSKGIYNSKANLIYCSIEGNQNVKKNQDYTLEMIKEEHLKAVFGKDKDLEEIKEIIEKGIDSIEVEKFTNFDNLKLHQQIALRYALFMKGTKAYEKAFRIIKLDKIKTISNGTQKRLARKIHEKLVSKFPDEVKQIDVNSKVVDNKQVSATRNDLAVDQETGEVNHLFKTDIQDTHSHCIDAMVAFYLVNRDFNFDKIYVDSSAIDQVTKSKTFINSDTIQSYKLFQDTVYSEHYRHFTKEEKIVDLLIKHSLLYMNKDNKKIYIEDKSQIETVAKIDNIKLSNLLFEAFKQKNESLLKELKPLDKKRYNTTRKDIINIFYAKEKLLPFEKIKGIPPYQEKTYKAVYKVLQNMEDFDFSTYQEIMTKFFKLQKGKEIKKDTFFLCHLLDKMLILESGGEIKLLLSVIKK

SEQ ID NO: 8817 - protein, 1254 aa, unidentified
  REGION 1..1254: note = Description of Unknown:uncultivated organism sequence
MKKLSISIDMGAKNNGIFIAKIDDDKIVDKKAKCIVIDKNSIKFSKVSRRANRHKVRNIKRRKLAKRLLWEVLDREHFTKEQQELIQGLLNNRGYTYLSTSSEFESLQEESVEFIKVYYEDLKDLKTKDDFLEFLSDDKFSDEKTLLEFLDKQIEKLEIEHKKKKSDFYKEFRADHSIIKSDLKILKEFFINIQKEINTGSKPRTKYFKEIKEEIEKYDFIKDKESFFNLIGNISNLQLRVLRKYFNDKFDDRFDDEKLYKKLNDYFRRFHDKDFETKVFEVFNTTKSSKEFLEKCSPTLTIPPYEDMNNRNSYKCNSMLIKDSVITESLKKSVDRLLQNSAFKVLDEDGLTYAQKLQRILDINSKIIPSTIYPRNVFKHQKDNSDIKWYQDILQDGFNEFSQFAKRYYREEGKVLSGIYEDSFLFRRCNLNTPYKNNIKHILLRPIYSYEFTKDEADKFLKDIKSVRGLQTSLKRVSEEAKNYQNSFYHIIEACFNNEECIEDKNIKTIIKNIDKNLSDLKTILQGKDTYLTTIDRVDSKNLKRVINIFKQTYEILFENISGFNKTCRHCTQENAVRSDEKCVIGKRLLSDVAKPIDGMLDMMLDRIAWEIVKDISKYDIEDVQNIEIVLEQNRFEFEESLIDIKKSGNNQIKQKKREYKDRLNVNVCPYTGKKFEKGDWDHILPRSKGIYNSKANLIYCSIEGNQNVKKNQDYTLEMIKEEHLKAIFGKDKNLEEIKEIIEKGLDSIDVEKFTNFDNLKLHQQIALRYALFMKGTKAYEKAFRIIKLDKIKTISNGTQKRLARKVHEKLISKFSDEMKQIDVNSKVVDNKQVSATRNDLAVDQETGEVNHLFKTDIQDAHSHCIDAMVAFYLVNKDFDFDEIYVDNSAIDQVTKSKTFINSENIKSYKLFQDTVYSEHYKHFTKEEKIVDLLIKHNLLYINKDNNKVYIEDKNQIETVAKIDKIKLSNLLFEAFEQKNESLLKALKPLDEKRYKTTRKDIINIFYSKEKLLPFEKIKKIPTYQEKTYKAVYKVLQKMETFDFNTYQEIMTKFFKLQKRKRNKKRHIFSLPSLGQNAKFRIKRGDQIAIVGSENIATKTFLVDGKLVQVPFFSKNVIPLKIADLLNAIKLNENAKAIYQVDINIDQIKEYVNKLVYTLTEASRLTVKVTLLKSAFDVDFDQIKQFNGAQDDEFRSFLQKYIQNKESILYSYLGSIRDTLNGKALLLDNSQHTITLQYKADINSYKKEIILNNI

SEQ ID NO: 8818 - protein, 1250 aa, unidentified
  REGION 1..1250: note = Description of Unknown:uncultivated organism sequence
MKFSISIDMGAKNNGVFIVKSDEYKIIEKSAKCIVIDKNSINFSKVNKRANRHKVRNIKRRKLAKRLLWEILDKKNYTKDEQDKIQGLLNNRGYTYLSSDDEFDKLQDETIEFFKEYFKEFKNLQTKDDFLEFLSNEKFLDEKVLNDFLNQNIEKLEIEYKKKKSEFYKNFQEFHNTIKSDLKLLKEFFQNLIKEINTGSKPRVKYFEDIKDEIKQFDFIQNKEEFFNLIANISNLQLRVLRKYFNDKFDNRFDDKKLYKKLNDYFKRFHNKEFEEKVFEIFNKYTSSKDFLKNCNPKLTIPPYEDMNNRHTYKCNSMLIKEEVITNSLKQSIDKILQSNYFEILNDKDLRYTQKLQRILDINSKLLPKEIYPRNVFKHQKDNANIKWYQNLLQDDFSEFSSFAKKYYMQEEKIINGIYDENFIFKKCNLNTPYKNNIKHTLLKPIYSYEFSQEEADKFLDDIKNTYGLQTALKRISDEAKKYQNSFYSVISACFENKNCVDDKEIKAIIKNLDKNLQEFKNILKDKNTYFSTIDKVDNKNIKRVLNIFKQTYEILFDNISGFNKTCKHCTIENSKRSDENNVIAKRLLSDVAKPIDGMLDMMLDRIAWEIVKDIKNDDLDDVEKLEIILEQNKFKFEENLIEIKKASNSQIKSKKREYKDKLNINICPYTGENFDKGDWDHILPRSKGLYNSKANLIYVSSKGNQIFKKDSDYKLENLNKKHLKAIFKTDNLNEIKEFITTHIQNIDKDKFSNFDNLKLPEQIALRYALFMKGSEAFKKALTIIKLDKLKTISNGTQKRLARLIQEKLKQKFPNKNLNVNAKVVDNKLISSTRKELAINKETGEVNHLFKEEFQDTHSHCIDAMVAFYLVNNKFNFEDIYLDSSGIDRVEKSKTFINSKSIKSYKLFQDTIYSENYTHFTKDEKIVDILIKYNLLYINENNKKIYIKDKAQIKNIAKIDNIRLSNLLFEAINKKDEELLKALKPLDKKRFNTTRKNIIDIFYQKDKLLPFHKIKNIPPYQEKTYKAIYKVLQDLEQFDYNKYYEKMAKFFKLNQRKRGKKRHLFSLPSLGQNAKFRIKRDEQIDIVGIKNIATKTYLINNKLVTIPFFSKNVIPLKISDLLNIIKLNKNVKSIFEIKIDTNEVKEYIQKLTYKLTEASRLTLEVTLVKNRFDIDFNKIKEFNGEKDKEFQNFLKEYIQNKNSAVYPYIGSIRDSLKGKAILINNNKDTITLKYKADTNSDKKNIILKNI

SEQ ID NO: 8819 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRVLDDTLNNKTLVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKENEVCSITKKDTVKKFEIDILGKKLGEVKKYGEPLSLLPEKN

SEQ ID NO: 8820 - protein, 1092 aa, unidentified
  REGION 1..1092: note = Description of Unknown:uncultivated organism sequence
MKYIIGLDIGIGSVGWAVVRNDDDCKRLEDFAVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRTIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8821 - protein, 1054 aa, unidentified
  REGION 1..1054: note = Description of Unknown:uncultivated organism sequence
MEQKLNYVIGLDIGIGSVGWAAINLDKRRIEDSGVRLFDSGEVLDQNKRKRTSQQRRGYRSTRRLVRRRAHRTERMKQWLEKIGLVSAETLAEYYEAPTAHPLELRVRGLTEKLTPAELAAALLHIGKHRGYNEFYQLDEEEKKSLSKEEKEDRSRAEAYERLIQAMPGMTPAQLYLSHPMFMSEFGVRYRNTNKQDESKKVLVPRTAIEAETRRICEKQAVFYPCLTEQNREKIYEILFRQRDFEDGPGDPNDKTRQYKGFLDTIGNCRFYPELKRGARQSVLGDLFVLINRLSQNRYFSAETGEVVDSADAYREIIEKALLSGELDLSDVKAVLKPYGIEMLNTNEKSADSPNRCLAFVRMIKPILEKNGYIWEDVIRAEYPFAPYREDSFLNRIGTILSQNRTPQRRVDLLKKAGVSEGIANALAKRKTGGTVSVSDRYMLESVEAFMNGELFGSYNARREKELLAQVRTGKKYKKLPPIEKGDYVDNPVVFRSINETRKVLNAIIEKYGSPNAINIEIAADLSRTFLERDLMRLENNRNRIETERIQKKIAELLQTKDEIMPVQVERYRLGEQQGWKCPYCGAPIMMETAIQKDERSYEIDHIVPYSLILDNTQHNKVLVHHGCNQAKGQRTPLMYLSADAAKKKEFIKWVNAAYAKKQKQISKRKREYLLQPDLNDERMQEWKTRNLNDTRYIAKYLVRYLNDNLLFDSEEKTNVHAVKGAITSQLRRVWLNKDTWGGDDKSELRKENNLHHAVDAVVIANCMPGYIELAEEALRLRRMYHEEGKRETENWTAVLNNAVDRLYRYYRMPKAYAEQMLRNIKRIPSFIPDLSEEVDARFCNCGLENEKQYRSKLRAFYADDPAFAAGIRMPLVSHKPNRKFSGSILISDVAKKDIDVRGDHLTKQIGENNYSRLDDRQYYCLEVYRCKDGTTGLRGIKYSWLKKKNGKLLISANYPENYASHECYLFKGDYVCIQKKKKDGYEAKYEGYYQSIKSINQGYLWFTDRIKTQNRVISIAKNDRFVKRDVSLLGDLGGMVSCGKPFLSEATRS

SEQ ID NO: 8822 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8823 - protein, 1090 aa, unidentified
  REGION 1..1090: note = Description of Unknown:uncultivated organism sequence
MIYIIGLDVGISSVGWAVIRVDKDCRRIEDFGVRIFDSGETRDRKQSKCQERRSFRGSRRLIRRRKHRKDRLKYFLNEISFVTEKEMKDFYGHNNHDIIDLRVKGLEERLTPEELTACLFHIAKFRGYKPFYDLEKVNLKTEDGKLLLHMNETNKIIENGGYRSVAEAIQKDSYFKEETTGKYRFHNKSDKNDILFSNGMIKKEAETILNCQKQYYSQLSDKNIEKIIDIIFSRRDFEDGPGNSDDKNRKYTGFYDSIGKCRFYKDKNRGCRFTVLGDVFALINKLSQFKYVSIETGEVDKLPKNLMHTIIMKAIKDASLTKKGIIKIAKEQGFTLVSGNEEKDDNTDITNCLKFVKPMKKIFDADDSGYEWGKLINEDPTNMDSLLNRIGVLLSYNITPNRRLEKLNSISEIRDNAIVERLSKVKLSGTANVSNEYMIDAINAFREGQLYGDFQANVIKDDFSSDKNATRHKKLPPFTKDSEIYDNPVVFRSVNECRKVVNAIIERYGTPSAINIEVASDLNRSAENRKKLANNQKKRRDNNASVLKKIADLLGVEESEITKSQLDRFKLAEQQGWRSIYSGDNLYSDDKGKITDKDKKAIILNTNKVYEIDHIIPFSRILDDSLNNKVLVFAKENQDKSDRTPLMYLEGDSRKEFIKRVNSFYQSKNENKEIGSISKIKYSYLMLDSLTSEEALKYLEEWKIRNLNDTRYISKYLVKYFNDNLLFEENKDSRRPPVYAVKGAITSMLRKQWLNKKTWGNPDKKKLKSVTNLDHAIDAIVIGNCLPAYVEIAVENIKLRDIYYSSGKKKTEEYYRSRDTFIDNLWKFYGVPKSESARLLEKMTETPSLINNLRQEVECRVQDYGTMQFFSKDDNGKTKEEWDEIYRRNITNFYVGQKDFVDSIQMPIVSHKQDKRFRGKIANSNFVKTTDDVSKFYKKQIDENNFAYMDDRSYYCVDVYKNHKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIYKCGEPLSYLPEKD

SEQ ID NO: 8824 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8825 - protein, 1095 aa, unidentified
  REGION 1..1095: note = Description of Unknown:uncultivated organism sequence
MKYIIGLDIGIGSVGWAVVRNDDDCKRLEDFGARIFESGEIIESNKNIRKSQRRRKYRGMRRRIRRRNHRKERLKNYLENIKFVNRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILSKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRSQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRCFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTDEYRKSLDNCVDTLMKYYGMSPTVSRKLLEKVKETPSLLKNIRFEVEYRVRDYELMKYFFNYDTKVGKDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8826 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESSGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKTVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNSVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAISNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKHIIYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 8827 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRTIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8828 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKKSDGKISEDDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDSLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKEDAISGKNSIKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8829 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRQQYIERYLLGELQGWRCMYSNEEITNKKEAILNKRKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIICCGYYFSLKDSSRNELYISKGNTRRKLNNMKEKEACSITKKDTVKKFEIDILGKKLGEVKKYGKPLSLLPEKN

SEQ ID NO: 8830 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFISRAELSEFFAKNNHDIIDIRVRALDEKVTPVELTAALLHIAKRRGYKAFYELSDENNNAKDKKAKEEKDIYKALTNTADVIKNGGYRSIAEAITKDSEHFSDKISGRYKYRNIKEKDEKGKKESSGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIATENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8831 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8832 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNADDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYHTKVGEDTLDQIFRNDLFKIYDHQFADSIDMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLTKCGEPLSLLPEKN

SEQ ID NO: 8833 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYKYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8834 - protein, 1094 aa, unidentified
  REGION 1..1094: note = Description of Unknown:uncultivated organism sequence
MKYIIGLDIGIGSVGWAVVRNDDDCKRLEDFGVRIFESGEIIENNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSGKISENDILFPTEMFEDEVRKILGKQKEFYPQLTDESIDKIFDIIFSRRDFEDGPGNADDKNRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8835 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8836 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRLRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNADDENRPYKGFVDSIGNCPYYKNEKRGHRYTVIGDLFALANKLSQYKYVEKNTGEVVKLPRDLMRNIVNQSLQSGNITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8837 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRLRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNADDENRPYKGFVDSIGNCPYYKNEKRGHRYTVIGDLFALANKLSQYKYVEKNTGEVVKLPRDLMRNIVNQSLQSGNITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAISAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEGEIRPQYIERYLLGELQGWRCMYSNEEITNKEEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYNHQFADSIEMPIVSIKPERKYSGQMVKDNFLKKRVANSENKYVKTIDKNNDALLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 8838 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESGGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSASIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8839 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFFVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8840 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTKAFREESTTISADAEIEKIYVDILGKKGKVLTKHGEPLSLLPEKN

SEQ ID NO: 8841 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVIKLPRNLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEGEIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYHTKVSEDTLDQIFRNDLYKIYDHQFADSIEMPIVSIKPERKYSGQMVKDRFIKKKDAISGKNSVKTIGENNSTVLNDSRFYCVEVYRTRSGNIDLQGIKYTDLVNKNKKLYLKPCYKYPENYYKYIMYLFKGDYLRIKGPKSIRLGFYKAVNYINQNSIKITRYNSKYTKAFREESTTINADAEIEKIYVDILGKKGKVLTKHGEPLSLLPEKN

SEQ ID NO: 8842 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEACSITKKDTVKKFEIDILGKKLGEVKKYGEPLSLLPEKN

SEQ ID NO: 8843 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGLGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8844 - protein, 560 aa, unidentified
  REGION 1..560: note = Description of Unknown:uncultivated organism sequence
MNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8845 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8846 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8847 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRVLDDTLNNKTLVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEVCSITKKDTVKKFEIDILGKKLGEVKKYGEPLSLLPEKN

SEQ ID NO: 8848 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8849 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8850 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSIKTIGENNSTVLNDSRFYCVDVYRTCNDETNLNFIKYTDLLKRNNHLYLRSDYRYPDDYAMHEMYLFRGDYIEITKKNKICCGYYFSLKDSSKNELYISKGNTRRKLNNMKEKEACSITKKDTVKKFEIDILGKKLGEVKKYGEPLSLLPEKN

SEQ ID NO: 8851 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRTIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFVDSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8852 - protein, 1035 aa, unidentified
  REGION 1..1035: note = Description of Unknown:uncultivated organism sequence
MRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKCGEPLSLLPEKN

SEQ ID NO: 8853 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRTIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8854 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVNRAELSKFFAKNNHDIIDIRVRALNEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSSKISENDILFPTEMFEDEVRKILGKQKEFYSQLTDESIDKIFDIIFSRRDFEDGPGNADDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAKKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMEYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8855 - protein, 1095 aa, unidentified
  REGION 1..1095: note = Description of Unknown:uncultivated organism sequence
MKYIIGLDIGIGSVGWAVVRNDDDCKRLENFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKEEAILNKGKQYEIDHIVPFSRILDDTLNNKALVLARENQKKGARTPLMYLPAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGKVKKYGKPLSLLPEKN

SEQ ID NO: 8856 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQFLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRQQYIERYLLGELQGWRCMYSNEEITNKKEAILNKRKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIICCGYYFSLKDSSRNELYISKGNTRRKLNNMKEKEACSITKKDTVKKFEIDILGKKLGEVKKYGKPLSLLPEKN

SEQ ID NO: 8857 - protein, 1120 aa, unidentified
  REGION 1..1120: note = Description of Unknown:uncultivated organism sequence
MINLYIKFLSSNLIIILKNIFVNRKERIMKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAQNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTKAFREESTTISADAEIEKIYVDILGKKGKVLTKHGEPLSLLPEKN

SEQ ID NO: 8858 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGENTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEVCSITKKDTVKKFEIDILGKKLGEVKKCGEPLSLLPEKN

SEQ ID NO: 8859 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVRKYGAPNAMNIEIASELNKSFDTRQKISTQQNKNEKERKNAIKQISLITGLDEREIRPQYIERYLLGELQGWRCMYSNEEITNKEEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8860 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADIIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYFAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIDMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8861 - protein, 1095 aa, unidentified
  REGION 1..1095: note = Description of Unknown:uncultivated organism sequence
MKYIIGLDIGIGSVGWAVVRNDEDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKESSSKISENDILFPTEMFEDEVRKILGKQKEFYPQLTDESIDKIFDIIFSRRDFEDGPGNTDDKNRPYKGFVDSIGNCPYYKNEKRGHRYTVIGDLFALANKLSQYKYVEKNTGEVVKLPRDLMRNIVGQSLQSGSITKTKINELAKELNIVILNTKTAKNENIADCIKYLKAVKPIFESYGFDWDKLISEKYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAITQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKSSSRNELYMSKGNTRRKLNNMKENEVCSITKKDTVKKFEIDILGKKLGEVKKYGEPLSLLPEKN

SEQ ID NO: 8862 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIGFVSRAELSEFFAKNNHDIIDIRVRALDEKVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYHTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKKNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8863 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVIKLPRNLMRNIVNQSLQSGSITKTKINELAKEFNIVILNTKTAKNENIADCIKYLKAVKPIFESYGFDWDKLISEEYTDQNSLLNRVGDTISFNITPKRRIDALNKINELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEGEIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIICCGYYFSLKDSSRNELYISKGNTRRKLNNMKEKEACSITKKDTVKKFEIDILGKKLGEVKKYGKPLSLLPEKN

SEQ ID NO: 8864 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNADDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKSSSRNELYMSKGNTRRKLNNMKENEVCSITKKDTVKKFEIDILGKKLGEVKKCGEPLSLLPEKN

SEQ ID NO: 8865 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKGLNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8866 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELGDENNNAKDKKAKEEEEKDIYKALTNTADVIKNGGYRSIAEAIMKDSEHFSDKVSGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSASIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRNLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYGYPDDYAMHEMYLFRGDYIEITKKNIIRCGYYFSLKDSSKNELYISKGNTRRKLNNMKEKEACSITKKDTVKKFEIDILGKKLGEVKKYGKPLSLLPEKN

SEQ ID NO: 8867 - protein, 1040 aa, unidentified
  REGION 1..1040: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQSWRCMYSNEEITNKKEAILNKEKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYM

SEQ ID NO: 8868 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRTIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKFYLKPGYKYPESYYKYIMYLFEGDYLRIKGPKSTRLGFYKAVNNINQNSIKITRYNSKYTRAFREESTTISADAEIEKIYVDILGKKGKVLTKHGEPLSLLPEKN

SEQ ID NO: 8869 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEACSITKKDTVKKFEIDILGKKLGEVKKYGEPLSLLPEKN

SEQ ID NO: 8870 - protein, 652 aa, unidentified
  REGION 1..652: note = Description of Unknown:uncultivated organism sequence
MIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPYRCFRRKIEHKGQLAYSIKCRSRK

SEQ ID NO: 8871 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEKDIYKALTNTADVIKNGGYRSIAEAIMKDSEHFSDKISGRYKYRNIKEKDEKGKKESSGKISENDILFPTEMFEDEVRKILSKQKEFYSQLTDESIDKIFDIIFSRRDFEDGPGNTDDENRRYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKAEKLLKLKPFDNNSEYAQNPVVFRAINETRKVVNAIVQKYGAPNAMNIEIASELNKSFDTRQKISTQQNKNEKERKNAIKQILLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVQKFEIDILGKKLGEVKKYGKPLSLLPEKN

SEQ ID NO: 8872 - protein, 1122 aa, unidentified
  REGION 1..1122: note = Description of Unknown:uncultivated organism sequence
MINLYIKFLSSNLIIILKNIFVNRKVRIMKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADIIKNGGYRSIAEAIMKDSEHFSDKISGRYKYRNIKEKDEKGKKKSDGKISENDILFPTEMFEDEVRKILGKQKEFYSQLTDESIDKIFDIIFSRRDFEDGPGNADDENRPYKGFVDSIGNCPYYKNEKRGHRYTVIGDLFALANKLSQYKYVEKNTGEVVKLPRNLMRNIVSQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVRKYGAPNAMNIEIASELNKSFDTRQKISTQQNKNEKERKNAIKQISLITGLDEREIRPQYIERYLLGELQGWRCMYSNEEITNKEEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVSEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIICCGYYFSLKDSSRNELYISKGNTRRKLNNMKEKEACSITKKDTVKKFEIDILGKKLGEVKKYGEPLSLLPEKN

SEQ ID NO: 8873 - protein, 1090 aa, unidentified
  REGION 1..1090: note = Description of Unknown:uncultivated organism sequence
MIYIIGLDVGISSVGWAVIRVDKDCRRIEDFGVRIFDSGETRDRKQSKCQERRSFRGSRRLIRRRKHRKDRLKYFLNEISFVTEKEMKDFYGHNNHDIIDLRVKGLEERLTPEELTACLLHIAKFRGYKPFYDFEKVNLKTEDGKLLLHMNETNKIIEDGGYRSVAEAIQKDSYFKEETTGRYRFHNKSDKNDILFSNGMIKKEAETILNCQKQYYSQLSDKNIEKITDIIFSRRDFEDGPGNSDDKNRKYTGFYDSIGKCRFYKDKNRGCRFTVLGDVFALINKLSQFKYVSIETGEVDKMPKNLMHTIIMKAIKDASLTKKGIIKIAKEQGFTLVSGNEEKDDNTDITNCLKFVKPMKKIFDADDSGFEWEKLINEDPTNIDSLLNRIGVLLSYNITPNRRLEKLNSISEIKDNAIVERLSKVKLSGTANVSNEYMIDAINAFREGQLYGDFQANVIKDDFSSDKNATRHKKIPPFTKDSEIYDNPVVFRSVNECRKVVNAIIEKYGTPSAINIEVASDLNRSTENRKKLANNQKKRRNNNASVLKKVADLLGVEESEVTKSQLDRFKLAEQQGWRSMYSGDNLYLDEKGKITDKDKKAIILNTNKVYEIDHIIPFSRILDDSLNNKVLVFAKENQDKSDRTPLMYLEGDSRKEFIKRVNSFYQSKNENKEIGSLSKIKYSYLMLDSLTSEEALKYLEEWKIRNLNDTRYISKYLVKYFNDNLLFEENKDSRRPPVYAVKGAITSMLRKQWLNKKTWGNPDKKKLKSVTNLDHAIDAIVIGNCLPAYVEIAVENIKLRDIYYSSGRKKTEEYYRSRDTFIDNLWKFYGVSKSESARLLEKMTETPSLINNLRQEVECRVQDYGTMQFFSKDDNGKTKEKWDEIYRRNITNFYVGQKDFVDSIQMPIVSHKQDKRFRGKIANSNFVKTTDDVSKFYKKQIDENNFAYMDDRSYYCVDVYENYKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIDKCGEPLSYLPEKD

SEQ ID NO: 8874 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8875 - protein, 684 aa, unidentified
  REGION 1..684: note = Description of Unknown:uncultivated organism sequence
MHFYCFFITHKQRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEVCSITKKDTVKKFEIDILGKKLGEVKKYGEPLSLLPEKN

SEQ ID NO: 8876 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTASLLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKSELKKITYFDHAVDAIVIANCLPAYVIIATENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8877 - protein, 1090 aa, unidentified
  REGION 1..1090: note = Description of Unknown:uncultivated organism sequence
MIYIIGLDVGISSVGWAVIRVDKDCRRIEDFGVRIFDSGETRDRKQSKCQERRNFRGSRRLIRRRKHRKDRLKYFLNEISFVTEKEMKDFYGHNNHDIIDLRVKGLEERLTPEELTACLFHIAKFRGYKPFYDLEKVNLKTEDGKLLLHMNETNKIIENGGYRSVAEAIQKDSYFKEETTGRYRFHNKSDKNDILFSNGMIKKEAETILNCQKQYYSQLSDKNIEKIIDIIFSRRDFEDGPGNSDDKNRKYTGFYDSIGKCRFYKDKNRGCRFTVLGDVFALINKLSQFKYVSIETGEVDKMPKNLMHTIIMKAIKDASLTKKGIIKIAKEQGFTLVSGNEEKDDNTDITNCLKFVKPMKKIFDADDSGYEWGKLINEDPTNMDSLLNRIGVLLSYNITPNRRLEKLNSISEIRDNAIVERLSKVKLSRTANVSNEYMINAINAFREGQLYGDFQAKVIKVNFSSNKNATKHKKLPPFTKDSEIYGNPVVFRSVNECRKVVNAIVERYGTPSAINIEVASDLNRSAENRKKLANNQKKRRDNNASVLKKVADLLGVEESEITKSQLDRFKLAEQQGWRSMYSGDNLYSDDKGKITDKDKKAIILNTNKVYEIDHIIPFSRILDDSLNNKVLVFAKENQDKSDRTPLMYLEGDSRKEFIKRVNSFYQSKNENKEIGSISKIKYSYLMLDSLTSEEALKYLEEWKIRNLNDTRYISKYLVKYFNDNLLFEENKDSRRPPVYAVKGAITSMLRKQWLNKKTWGNPDKKKLKSVTNLDHAIDAIVIGNCLPAYVEIAVENIKLRDIYYSSGKKKTEEYYRSRDTFIDNLWKFYGVPKSESARLLKKMTETPSLINNLRQEVECRVQDYGTMQFFSKDDNGKTKEEWDEIYRRNITNFYVGQKDFVDSIQMPIVSHKQDKRFRGKIANSNFVKTTDDVSKFYKKQIDENNFAYMDDRSYYCVDVYKNHKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIYKCGEPLSYLPEKD

SEQ ID NO: 8878 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIATENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8879 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHHYTVIGDLFALANKLSQYKYVEKNTGEVVKLPRNLMRNIVNQSLQSGSITKTKINELAKEFNIVILNTKTAKNENIADCIKYLKAVKPIFESYGFDWDKLISEEYTAQNSLLNRVGDTISFNITPKRRIDALNKIDELKGKDELIKKLSKQNFSGTAKVSDKYMIDAINAFFDGTLVGEFQTNVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKSSSRNELYMSKGNTRRKLNNMKENEVCSITKKDTVKKFEIDILGKKLGEVKKCGEPLSLLPEKN

SEQ ID NO: 8880 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESSGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKTVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEGEIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKCDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLSFIKYTDLLKRNNHLYLRSDYRYPDDYAMHEMYLFYGDYIEITKKNKICCGYYFSLKNSLRNELYISKGNTRRRLNNMKENEVCSITKKDTVKKFEIDILGKKLGEVKKCGEPLSLLPEKN

SEQ ID NO: 8881 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRTIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8882 - protein, 636 aa, unidentified
  REGION 1..636: note = Description of Unknown:uncultivated organism sequence
MIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8883 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFISRAELSEFFAKNNHDIIDIRVRALDEKVTPVELTAALLHIAKRRGYKAFYELSDENNNAKDKKAKEEKDIYKALTNTADVIKNGGYRSIAEAITKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQSWRCMYSNEEITNKKEAILNKEKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEACSITKKDTVKKFEIDILGKKLGEVKKYGEPLSLLPEKN

SEQ ID NO: 8884 - protein, 1091 aa, unidentified
  REGION 1..1091: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKIAEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8885 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKEEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8886 - protein, 1095 aa, unidentified
  REGION 1..1095: note = Description of Unknown:uncultivated organism sequence
MKYIIGLDIGIGSVGWAVVRNDDDCKRLEDFGVHIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNERRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8887 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8888 - protein, 1091 aa, unidentified
  REGION 1..1091: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEKDIYKALTNTADIIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQHIERYLLGELQGWRCMYSNEEITNKEEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLIKCGEPLSLLPEKN

SEQ ID NO: 8889 - protein, 1089 aa, unidentified
  REGION 1..1089: note = Description of Unknown:uncultivated organism sequence
MDLISESVQWAVVRNDDDCKRLEDFGVRIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKKSDGKISEDDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDSLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKEDAISGKNSIKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8890 - protein, 1148 aa, unidentified
  REGION 1..1148: note = Description of Unknown:uncultivated organism sequence
MKQQIKYVLGLDIGIGSVGWAVVRAEGEPRIEDFGVRIFDSGENSKKKERASQKRRAYRSGRRLVRRRAHRKARIRFWFQKQGIASQKEIDAFFEGDEKDIIGLRVRALDEKLEPAEIAACMIHISNHRGYSGFYDGEEDSGDEDEAENAAGVQAVCELMRAGGYRSIAEMIARDKAFEEAGKPYRRYRNRAGYSVRYVMPRDEVKKEAEAILMAQGNFYPAIDAAFREKILGILFSQRDFEDGPGDAADAHRKYSGFLDNEGSCRFYHDEKRGHRFTYLADEYALVNVLSQYRYFDEASGEMTFSSELAESLLSRAVRQGGLQMNDVKSIAKEYGLKVIAAKTDKRDSITQAMKYLKAVRPLFIKAGFDWEELISEDAADMEGCLLNRVGETLSVNITPRRRRERLKKIGRIAECKELIEDLTKLHLSGTANVSYKYMAGAVSAFLEGEIYGKFQAKAGEAAEDLEEDRHYKLKAFDKTFEFYKNPVVMRSIAQARKAINRVIEEYGSPYAINIEVGSELSKSFDARAEQMAEQAKNERARIAVKREIAGLLSIPEEGVTPVMIERYFLGEQQNWQCMYSGRPIDKVSALRNADKSYEIDHIVPFSLVLDNTLHNKVLVWHGENQAKGQRVPLEYLRGEAEDAFRKRVNLLFRGKKISEKKYNYLLAKSAYDSELIGSWKSRNLNDMRYISRFLVQYLKKNLQFRPADAQDDYRPEVYAVKGAITSQMRRLWLNRQTWGMQDKSVLKENTYLDHAADAIVVACCLPAYIEMTAVHQRLKQILKNNGGLPNAEYEGVLAAAKENIGKFYHIPATRLEYYLTQRDARPSLIRDLRREVDIRLQDADTVNFFESLRAKEEGRQARPLSEDAAADKFRMETLAFYKDDPAFAKSLRMPFTVHISSRKASGKVTDDNAVRIVENSEGTFKLSRKLVFDLTRKDMEKLYTRDEDLKASLAALFADRKEDEPLGKILAERGETEFRTQKGTPVRRVTLCDTAKRTLRKQISETNYSLLPDTSYYCVEIYRDEKGRTCAAGIAFSDIVVRGGRVRLREGFAHPEGYKEHCLYLFTNDYIRITNAKGVKFEGYYRSVYSINQAEFYYMRRNTPLRAKKYFTLAFRDTVEKLSVDPIGRIGGVIGCGEPLLSVRESE

SEQ ID NO: 8891 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADIIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSVKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYHTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8892 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKCGEPLSLLPEKN

SEQ ID NO: 8893 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSIKTIGENNSTVLNDSRFYCVDVYRTCNDETNLNFIKYTDLLKRNDHLYLRSDYRYPDDYAMHEMYLFRGDYIEITKKNKICCGYYFSLKDSSKNELYISKGNTRRKLNNMKEKEACSITKKDTVKKFEIDILGKKLGEVKKYGEPLSLLPEKN

SEQ ID NO: 8894 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFVDSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8895 - protein, 520 aa, unidentified
  REGION 1..520: note = Description of Unknown:uncultivated organism sequence
MITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFVDSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8896 - protein, 555 aa, unidentified
  REGION 1..555: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRTIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKIST

SEQ ID NO: 8897 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKEKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTKAFREESTTISADAEIEKIYVDILGKKGKVLTKHGEPLSLLPEKN

SEQ ID NO: 8898 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKEEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENNKLRDIYYSAGKIKTEEYRKSLDNCVDTLMKYYGMSPAVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8899 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRNLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASDLNKSFDTRQKISTQQNKNEKERKNAIKQISLITGLDEGEIRPQYIERYLLGELQGWRCMYSNEEITNKKEAILNKRKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8900 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKNSGRYKYRNIKEKDEKGKKESSSKISENDILFPTEMFEDEVRKILGKQKEFYPQLTDESIDKIFDIIFLRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8901 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKYEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8902 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEEEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8903 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEEEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKAELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYHTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8904 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8905 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSIKTIGENNSTVLNDSRFYCVDVYRTCNDETNLNFIKYTDLLKRNNHLYLRSDYRYPDDYAMHEMYLFRGDYIEITKKNKICCGYYFSLKDSSKNELYISKGNTRRKLNNMKEKEACSITKKDTVKKFEIDILGKKLGEVKKYGEPLSLLPEKN

SEQ ID NO: 8906 - protein, 1091 aa, unidentified
  REGION 1..1091: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEKYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8907 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKSELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8908 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIKFVNRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILSKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRSQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRCFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTDEYRKSLDNCVDTLMKYYGMSPTVSRKLLEKVKETPSLLKNIRFEVEYRVRDYELMKYFFNYDTKVGKDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8909 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKEEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENNKLRDIYYSAGKIKTEEYRKSLDNCVDTLMKYYGMSPAVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYMSKGNTRRKLNNMKENEVCSITKKDTVKKFEIDILGKKLGEVKKCGEPLSLLPEKN

SEQ ID NO: 8910 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVAFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSTEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYVEITKKNIIRCGYYFSLKDSSKNELYISKGNTRRKLNNMKEKEACSITKKDTVKKFEIDILGKKLGKVKKYGKPLSLLPEKN

SEQ ID NO: 8911 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8912 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIATENHKLRDIYYSAGKIKTEEYRKSLDNCVDTLMKYYGMSPTVSRKLLEKVKETPSLLKNIRFEVEYRVRDYELMKYFFNYDTKVSEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCFKYPENYYKHIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8913 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8914 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKNSGRYKYRNIKEKDEKGKKESSSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8915 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRTIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDLIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8916 - protein, 1091 aa, unidentified
  REGION 1..1091: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSSGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIISIKPERKYSGQMVKDNFLKKRVANSENKYVKTIDKNNDAVLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTTISADAEIEKIYVDILGKKGKVLTRHGEPLSLLPEKN

SEQ ID NO: 8917 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILSKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRSQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRCFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTDEYRKSLDNCVDTLMKYYGMSPTVSRKLLEKVKETPSLLKNIRFEVEYRVRDYELMKYFFNYDTKVGKDTLDQIFRNDLYKIYDHQFADSIEMPIVSIKPERKYSGQMVKDGFIKKKDAISEKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8918 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESGGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKPPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8919 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8920 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILSKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRSQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRCFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTDEYRKSLDNCVDTLMKYYGMSPTVSRKLLEKVKETPSLLKNIRFEVEYRVRDYELMKYFFNYDTKVGKDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8921 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8922 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8923 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNQNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKAELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYHTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8924 - protein, 1091 aa, unidentified
  REGION 1..1091: note = Description of Unknown:uncultivated organism sequence
MKYIIGLDIGIGSVGWAVVRNDDDCKRLEDFGVRIFESGEIIESNKNIRKSQRRRKYRGMRRRLRRRNHRKERLKNYLENIEFVSRAELSEFFAKNNHDIIDIRVRALDEMVTPVELTAALLHIAKRRGYKAFYDLSDENNNAKDKKAKEEKDIYKALTNTADVIKNGGYRSIAEAIMKDSEHFSDKISGRYKYRNIKEKDEKGKKESSSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRQQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8925 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELAAALLHIAKRRGYKAFYELSDENNNAKDKKAKEEEEKDIYKALTNTADVIKNGGYRSIAEAIMKDSEHFSDKISGRYKYRNIKEKDEKGKKESSSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLTKCGEPLSLLPEKN

SEQ ID NO: 8926 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSKVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8927 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTKAFREEATTISADAEIEKIYVDILGKKGKVLTKHGEPLSLLPEKN

SEQ ID NO: 8928 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESSGKISENDILFPTEMFEDEVRKILGKQKEFYPQLTDESIDKIFDIIFSRRDFEDGPGNADDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEGEIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKCDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLSFIKYTDLLKRNNHLYLRSDYRYPDDYAMHEMYLFYGDYIEITKKNKICCGYYFSLKNSLRNELYISKGNTRRRLNNMKENEVCSITKKDTVKKFEIDILGKKLGEVKKYGEPLSLLPEKN

SEQ ID NO: 8929 - protein, 1090 aa, unidentified
  REGION 1..1090: note = Description of Unknown:uncultivated organism sequence
MIYIIGLDVGISSVGWAVIRVDKDCRRIEDFGVRIFDSGETRDRKQSKCQERRSFRGSRRLIRRRKHRKDRLKYFLNEISFVTEKEMKDFYGHNNHDIIDLRVKGLEERLTPEELTACLLHIAKFRGYKPFYDFEKVNLKTEDGKLLLHMNETNKIIEDGGYRSVAEAIQKDSYFKEETTGRYRFHNKSDKNDILFSNGMIKKEVETILNCQKQYYSQLSDKNIEKITDIIFSRRDFEDGPGNSDDKNRKYTGFYDSIGKCRFYKDKNRGCRFTVLGDVFALINKLSQFKYVSIETGEVDKMPKNLMHTIIMKAIKDASLTKKGIIKIAKEQGFTLVSGNEEKDDNTDITNCLKFVKPMKKIFDADDSDFEWEKLINEDPTNMDSLLNRIGVLLSYNITPNRRLEKLNSIPEIKDNAIVERLSKVKLSGTVNVSNEYMIDAINAFREGQLYGDFQANVIKDDFSSDKNATRHKKLPPFTKDSEIYDNPVLFRSVNECRKVVNAIIERYGTPSAINIEVASDLNRSAENRKKLANNQKKRRNNNASVLKKVADLLGVEESEITKSQLDRFKLAEQQGWRSMYSGDNLYLDEKGKITDKDKKAIILNTNKVYEIDHIIPISRILDDSLNNKVLVFAKENQDKSDRTPLMYLEGDSRKEFIKRVNSFYQSKNENKEIGSISKIKYSYLMLDSLTSEEALKYLEEWKIRNLNDTRYISKYLVKYFNDNLLFEENKDSRRPPVYAVKGAITSMLRKQWLNKKTWGNPDKKKLKSVTNLDHAIDAIVIGNCLPAYVEIAVENIKLRDIYYSSGRKKTEEYYRSRDTFIDNLWKFYGVPKSESARLLEKMTETPSLINNLRQEVECRVQDYGTMQFFSKDDNGKTKEEWDEIYRRNITNFYVGQKDFVDSIQMPIVSHKQDKRFRGKIANSNFVKTTDDVSKFYKKQIDENNFAYMDDRSYYCVDVYENYKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIDKCGEPLSYLPEKD

SEQ ID NO: 8930 - protein, 1094 aa, unidentified
  REGION 1..1094: note = Description of Unknown:uncultivated organism sequence
MKYIIGLDIGIGSVGWAVVRNDNDCKRLEDFGVRIFESGEIIESNKNIRKSQRRRKYRGMRRRIRRRNHRKERLKNYLENIEFVNRAELSEFFAKNNHDIIDIRVRALDEKVTPVELTAALLHIAKRRGYKAFYELSDENNNAKDKKAKEEEKDIYKALTNTADIIKNGGYRSIAEAIMKDSEHFSDKISGRYKYRNIKEKDEKGKKESSSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVRKYGAPNAMNIEIASELNKSFDTRQKISTQQNKNEKERKNAIKQISLITGLDEREIRPQYIERYLLGELQGWRCMYSNEEITNKKEAILNKGKKYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8931 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSGKISENDILFPTEMFEDEVRKILGKQKEFYPQLTDESIDKIFDIIFSRRDFEDGPGNADDENRPYKGFVDSIGNYPYYKNEKRGHRYTVIGDLFALANKLSQYKYVEKNTGEVVKLPRDLMRNIVSQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPAVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 8932 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRTIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSEQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNVIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8933 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPVNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8934 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKGLNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVSEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8935 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKSELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8936 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSSKISENDILFPTEMFEDEVRKILGKQKEFYSQLTDESIDKIFDIIFSRRDFEDGPGNADDENRPYKGFVDSIGNCPYYKNEKRGHRYTVIGDLFALANKLSQYKYVEKNTGEVVKLPRNLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRQQYIERYLLGELQGWRCMYSNEEITNKKEAILNKRKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYIEITKKNIICCGYYFSLKDSSRNELYISKGNTRRKLNNMKEKEACSITKKDTVKKFEIDILGKKLGEVKKYGKPLSLLPEKN

SEQ ID NO: 8937 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNITVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEVCSITKKDTVKKFEIDILGKKLGEVKKYGEPLSLLPEKN

SEQ ID NO: 8938 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8939 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESSSKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRNLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASDLNKSFDTRQKISTQQNKNEKERKNAIKQISLITGLDEGEIRPQYIERYLLGELQGWRCMYSNEEITNKKEAILNKEKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLSFIKYTDLLKRNNHLYLRSDYRYPDDYAMHEMYLFYGDYIEITKKNKICCGYYFSLKNSLRNELYISKGNTRRRLNNMKENEVCSITKKDTVKKFEIDILGKKLGEVKKCGEPLSLLPEKN

SEQ ID NO: 8940 - protein, 1092 aa, unidentified
  REGION 1..1092: note = Description of Unknown:uncultivated organism sequence
MKYIIRLDIGIGSVGWAVVRNDNDCKRLEDFGVRIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDKKGKKKSDGKISENDILFPTEMFEDEVRKILGKQKEFYPQLTDESIDKIFDIIFSRRDFEDGPGNADDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKAVKPIFESYGFDWDKLISEEYTDQNSLLNRVGDTISFNITPKRRIDALNRIDELKGKDELIKKLSKQNFSGTAKVSDKYMIDAINAFFDGTLVGEFQANVQQEEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSTEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKHIIYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 8941 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVNRAELSKFFAKNNHDIIDIRVRALNEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSSKISENDILFPTEMFEDEVRKILGKQKEFYSQLTDESIDKIFDIIFSRRDFEDGPGNADDENRPYKGFVDSIGNCPYYKNEKRGHRYTVIGDLFALANKLSQYKYVEKNTGEVVKLPRDLMRNIVSQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRILDDTLNNKALVLARENQKKGARTPLMYLSAKKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKHIIYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 8942 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNADDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNRIDELKGKDELIKKLSKQNFSGTAKVSDKYMIDAINAFFDGTLVGEFQANVQQEEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPTVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLSFIKYTDLLKRNNHLYLRSDYRYPDDYAMHEMYLFYGDYIEITKKNKICCGYYFSLKNSLRNELYISKGNTRRRLNNMKENEVCSITKKDTVKKFEIDILGKKLGEVKKCGEPLSLLPEKN

SEQ ID NO: 8943 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 8944 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFNWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8945 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRTIAEAIMKDSEHFSDKISGRYKYRNIKEKDEKGKKKSDGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVSQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8946 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESSGKISENDILFPTEMFEDEVRKILSKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANIQQDEFSVSIKTEKLLKLKPFDNNSEYAQNPVAFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSTEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDRFIKKKDAISGKNSVKTIGENNSTVLNDSRFYCVDVYRTCNDETNLNFIKYTDLLKRNNHLYLRSDYRYPDDYAMHEMYLFRGDYVEITKKNIIRCGYYFSLKDSSKNELYISKGNTRRKLNNMKEKEACSITKKDTVKKFEIDILGKKLGKVKKYGKPLSLLPEKN

SEQ ID NO: 8947 - protein, 1092 aa, unidentified
  REGION 1..1092: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIGFVSRAELSEFFAKNNHDIIDIRVRALDEMVTPVELTASLLHIAKRRGYKAFYELSDENNNAKDKKAKEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKIAEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8948 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESGGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSASIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIGITKKNKICCGYYFSLKNSSRNELYMSKGNTRRKLNNMKENEVCSITKKDTVKKFEIDILGKKLGEVKKYGEPLSLLPEKN

SEQ ID NO: 8949 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKKSDGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKELNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDNFLKKRVANSENKYVKTIDKNNDAVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 8950 - protein, 1094 aa, unidentified
  REGION 1..1094: note = Description of Unknown:uncultivated organism sequence
MKYIIGLDIGIGSVGWAVVRNDDDCKRLEDFGVRIFESGEIIESNKNIRKSQRRRKYRGMRRRIRRRNHRKERLKNYLENIEFVSRAELSEFFAKNNHDIIDIRVRALDEKVTPVELTAALLHIAKRRGYKAFYELSDENNNAKDKKAKEEEKDIYKALTNTADVIKNGGYRSIAEAIMKDSEHFSDKISGRYKYRNIKEKDEKGKKESGGKISENDILFPTEMFEDEVRKILGKQKEFYSQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSASIKTEKLLKLKPFDNNSEYAQNPVGFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 8951 - protein, 1093 aa, unidentified
  REGION 1..1093: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIEFVSRAELSEFFAKNNHDIIDIRVRALDEMVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKGKQYEIDHIVPFSRILDDTLNNKALVLARENQKKGARTPLMYLSAEKEKEFKQRVNKLFKGNKITEKKYRYFMLESLVGEDAEKTLGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 8952 - protein, 1090 aa, unidentified
  REGION 1..1090: note = Description of Unknown:uncultivated organism sequence
MIYIIGLDVGISSVGWAVIRVDKDCRRIEDFGVRIFDSGETRDRKQSKCQERRSFRGSRRLIRRRKHRKDRLKYFLNEISFVTEKEMKDFYGHNNHDIIDLRVKGLEERLTPEELTACLFHIAKFRGYKPFYDLEKVNLKTEDGKLLLHMNETNKIIENGGYRSVAEAIQKDYYFKEETTGRYRFHNKSDKNDILFSNGMIKKEAETILNCQKQYYSQLSDKNIEKIIDIIFSRRDFEDGPGNSDDKNRKYTGFYDSIGKCRFYKDKNRGCRFTVLGDVFALINKLSQFKYVSIETGEVDKMPKNLMHTIIMKAIKDASLTKKGIIKIAKEQGFTLVSGNEEKDDNTDITNCLKFVKPMKKIFDADDSGFEWEKLINEDPTNMDSLLNRIGVLLSYNITPNRRLEKLNSISEIRDNAIVERLSKVKLSGTANVSNEYMIDAINAFREGQLYGDFQANVIKDDFSSDKNATRHKKLPPFTKDSEIYDNPVVFRSVNECRKVVNAIIERYGTPSAINIEVASDLNRSAENRKKLANNQKKRRDNNASVLKKVADLLGVEESEITKSQLDRFKLAEQQGWRSMYSGDNLYSDDKGKITDKDKKAIILNTNKVYEIDHIIPFSRILDDSLNNKVLVFAKENQDKSDRTPLMYLEGDSRKEFIKRVNSFYQSKNENKEIGSISKIKYSYLMLDSLTSEEALKYLEEWKIRNLNDTRYISKYLVKYFNDNLLFEENKDSRRPPVYAVKGAITSMLRKQWLNKKTWGNSDKKKLKSVTNLDHAIDAIVIGNCLPAYVEIAVENIKLRDIYYSSGKKKTEEYYRSRDTFIDNLWKFYGVPKSESARLLEKMTETPSLINNLRQEVECRVQDYGTMQFFSKDDNGKTKEKWDEIYRRNITNFYVGQKDFVDSIQMPIVSHKQDKRFRGKIANSNFVKTTDDISKFYKKQIDENNFAYMDDRSYYCVDVYENHKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIDKCGEPLSYLPEKD

SEQ ID NO: 8953 - protein, 1090 aa, unidentified
  REGION 1..1090: note = Description of Unknown:uncultivated organism sequence
MIYIIGLDVGISSVGWAVIRVDKDCRRIEDFGVRIFDSGETRDRKQSKCQERRSFRGSRRLIRRRKHRKDRLKYFLNEISFVTEKEMKDFYGHNNHDIIDLRVKGLEERLTPEELTACLFHIAKFRGYKPFYDLEKVNLKTEDGKLLLHMNETNKIIENGGYRSVAEAIQKDYYFKEETTGRYRFHNKSDKNDILFSNGMIKKEAETILNCQKQYYSQLSDKNIEKIIDIIFSRRDFEDGPGNSDDKNRKYTGFYDSIGKCRFYKDKNRGCRFTVLGDVFALINKLSQFKYVSIETGEVDKMPKNLMHTIIMKAIKDASLTKKGIIKIAKEQGFTLVSGNEEKDDNTDITNCLKFVKPMKKIFDADDSGFEWEKLINEDPTNMDSLLNRIGVLLSYNITPNRRLEKLNSISEIRDNAIVERLSKVKLSGTANVSNEYMIDAINAFREGQLYGDFQAKVIKDDFSSDKNATRHKKLPPFTKDSEIYDNPVVFRSVNECRKVVNAIIERYGTPSAINIEVASDLNRSAENRKKLANNQKKRRDNNASVLKKVADLLGVEESEITKSQLDRFKLAEQQGWRSMYSGDNLYSDDKGKITDKDKKAIILNTNKVYEIDHIIPFSRILDDSLNNKVLVFAKENQDKSDRTPLMYLEGDSRKEFIKRVNSFYQSKNENKEIGSISKIKYSYLMLDSLTSEEALKYLEEWKIRNLNDTRYISKYLVKYFNDNLLFEENKDSRRPPVYAVKGAITSMLRKQWLNKKTWGNSDKKKLKSVTNLDHAIDAIVIGNCLPAYVEIAVENIKLRDIYYSSGKKKTEEYYRSRDTFIDNLWKFYGVPKSESARLLEKMTETPSLINNLRQEVECRVQDYGTMQFFSKDDNGKTKEKWDEIYRRNITNFYVGQKDFVDSIQMPIVSHKQDKRFRGKIANSNFVKTTDDISKFYKKQIDENNFAYMDDRSYYCVDVYENHKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIDKCGEPLSYLPEKD

SEQ ID NO: 8954 - protein, 1040 aa, unidentified
  REGION 1..1040: note = Description of Unknown:uncultivated organism sequence
MIYIIGLDVGISSVGWAVIRVDKDCRRIEDFGVRIFDSGETRDRKQSKCQERRSFRGSRRLIRRRKHRKDRLKYFLNEISFVTEKEMKDFYGHNNHDIIDLRVKGLEERLTPEELTACLFHIAKFRGYKPFYDLEKVNLKTEDGKLLLHMNETNKIIENGGYRSVAEAIQKDYYFKEETTGRYRFHNKSDKNDILFSNGMIKKEAETILNCQKQYYSQLSDKNIEKIIDIIFSRRDFEDGPGNSDDKNRKYTGFYDSIGKCRFYKDKNRGCRFTVLGDVFALINKLSQFKYVSIETGEVDKMPKNLMHTIIMKAIKDASLTKKGIIKIAKEQGFTLVSGNEEKDDNTDITNCLKFVKPMKKIFDADDSGFEWEKLINEDPTNMDSLLNRIGVLLSYNITPNRRLEKLNSISEIRDNAIVERLSKVKLSGTANVSNEYMIDAINAFREGQLYGDFQANVIKDDFSSDKNATRHKKLPPFTKDSEIYDNPVVFRSVNECRKVVNAIIERYGTPSEINIEVASDLNRSAENRKKLANNQKKRRDNNASVLKKVADLLGVEESEITKSQLDRFKLAEQQGWRSMYSGDNLYSDDKGKITDKDKKAIILNTNKVYEIDHIIPFSRILDDSLNNKVLVFAKENQDKSDRTPLMYLEGDSRKEFIKRVNSFYQSKNENKEIGSISKIKYSYLMLDSLTSEEALKYLEEWKIRNLNDTRYISKYLVKYFNDNLLFEENKDSRRPPVYAVKGAITSMLRKQWLNKKTWGNSDKKKLKSVTNLDHAIDAIVIGNCLPAYVEIAVENIKLRDIYYSSGKKKTEEYYRSRDTFIDNLWKFYGVPKSESARLLEKMTETPSLINNLRQEVECRVQDYGTMQFFSKDDNGKTKEKWDEIYRRNITNFYVGQKDFVDSIQMPIVSHKQDKRFRGKIANSNFVKTTDDISKFYKKQIYENNFAYMDDRSYYCVDVYENHKGNTKITALKYNDIIKKNGKLYLKQDYKFPEDYREHLMYLYSGDFISVENKNSKYYGYYVSVKNINRNFLNIDEFIY

SEQ ID NO: 8955 - protein, 1110 aa, unidentified
  REGION 1..1110: note = Description of Unknown:uncultivated organism sequence
MNIDKLIHQISKFHFDYNIKTMFCQERMVNLKYIIGLDVGIGSVGWAVVRNEENCKRIEDFGVRIFDSGETSKNNQQKRKSQIRREYRGIRRQIRRKKHRRERLKNYLEQIGLVSREEIVDFFKKNNHDIIDIRVSALDKKVSPQELAAALLNISKHRGYTPFYEKVDEKDDEGMLLKAVTKTEKIIKEGGYRSIAEAIKYDTQHFSEKTTGRYKYRNSNKKEKSKKSIDILFPNKMLRVEVRKILNKQKQYYPQLTDESIEIIFDIIFSHRDFEDGPGDPNDKNRPYKGFYDSIGNCPFYTNEKRAHRFTVIGDLFSLANKLSQYRYVSTNTGEIENPPELMKSVVKFAMEKGQISKQELNSIAKTYQIKILNPETSKNENIADCFKYLKVVKPIFEDHGFAWNDLITDDYLKSDSLLNRVGMALSRNQTPARRIKALNNIEELCGKDKLIEKMSKQNFSGTCKVSEKYMKEAINAFLNGTPVGKFQAQFNKNKFDFDRSVKKKLKLPPLDINNEFAKNPVVFRAINEARKVVNAIIKEYGVPNALNIEVAGELSKSFTARNTIIKEQNQNEKNRNDAISAVAEILQIRESEVTGSQIERYQLGELQGWHCMYSNAEINDKKEAIENLNKSYEVDHIVPFSRILDDTYNNKALVCSKENQEKSDQTPLMYLSGIKKKEFISRVNKMYKEKKITKKKYDYFMLESMVGEKANELLDDWKTRNLNDTRTIAKFLVKYFNDNLQFNRDENDEKRPAVYAVKGAITSMLRRQWLNKNTWGKYDKRELKKITYFDHAVDAIVVANCLPVYVIIAMENRKLRDIYYSEGKKKTSEYCNSLNNCVVAINKFYGMSKHISKPLLEKLTETPSLIKNLRLEVEYRVRDYELMRYFIKGAENKSDEELDELFRQDVQKFYSNDKVFADSIKMPIVSIKPERKYSGQMTKDKLFKKNSKEAKTAFVNNIGENNVSYINNSCYYCTEVYKTTKGKTSITGIKYTDIVNKDKKLYLKPCYRYPEDYAEHTMYLFKGDYIEIFQKNVKDSSSKVKRRGFYLSVYNINEKRICMTKNNSRRNSENCNIAQKDNIEKYYIDILGKKRGVIKKKCGEPLSLLREND

SEQ ID NO: 8956 - protein, 1079 aa, unidentified
  REGION 1..1079: note = Description of Unknown:uncultivated organism sequence
MKYIIGLDVGIGSVGWAVVRNEENCKRIEDFGVRIFDSGEDLKKQKRESQIRREYRGTRRQIRRRRQRKERLKNFLESIGLVSKADITQFFNKNDHDIIDIRVRALDTKISPQELAAALLNIANHRGYKPFYEEKDEKSNEGKLYAAVTRTEKIIKDGGYRSIAEAIMKDTEHFSEKATGRYKYRNSEEKNDILFPNAMYEEETRKILNRQKSYYPQLTEDNIEKIFKIIFSRRDFEDGPGNPQDENRPYKGFYDTIGNCPFYTNEKRGHRFTVIGDMFALVNKLSQYRYVSTETGEVEKLPKNLMKSVVEFAMQNGQITKKELNSIAKNYCIEILNPETSKNENIADCFRFLKAVKPIFENEGFVWKDLIADDYLNLNSLLNRVGTVLSSNITPSRRIRALNGITELEGRETLIKKLSKQNFSGTANVSDRYMTEAITAFFKGTPSGEFQAQFIKSEFDNAASSEKKLKLPPFDSKNEYAKNPVVFRAINETRKIVNAIIEKYGAPNALNIEVAGELSKSFESRSKISKKQNENEKIRKDAVSAVAEILGISESEVNGSQIERYRLGELQGWRCMYSNEEISDKKEAIENRNKTYEVDHIVPFSRILDDTLNNKALVLAKENQQKSNKTPLMYLTGEKKKFFKSRVNKLYKEKKINKTKYSYFMLESLVGEEADKILGDWKTRNLNDTRYIAKFLVQYFKDNLKFQRESSDEKRPVVYAVKGAITSSLRRQWLNKETWGQYDKDKLKKITYFDHAVDAIVIANCLPAYVIIAAENQKLRDIYYSAGRKKTDEYNRSLENCVVNLSKFYGMNPNVSRKLLGKVKETPSLIENLRLEVEYRVRDHELMRYFIKDAENKSDEELDKLFRQDLHKLYYNDIEFADSIQMPIVSIKPERKYSGKITKDTLMKKNKADDNCYIKNIGEDNISFMDDSCYYCVEVYTTKSGKTSLLGIKRTDIVKKDKKLYLKPYYKYPEDYAEHIMYLFKGDYIEISQKIAKTNTEKVKRRGFYLSINNINQNSIVITKDNTRRKLSNTNRVETCSISQKDIIKKYDIDILGKKGGEIKECGEPLSLLPENDLT

SEQ ID NO: 8957 - protein, 1095 aa, unidentified
  REGION 1..1095: note = Description of Unknown:uncultivated organism sequence
MKYIIGLDIGIGSVGWAVVRNDDDCKRLEDFGVRIFESGEIIESNKNIRNSQRRRKYRGMRRRIRRRNHRKERLKNYLENIGFVSRAELSEFFAKNNHDIIDIRVRALDEKVTPVELTAALLHIAKRRGYKAFYELSDENNNAKDKKAKEEEEKDIYKALTNTADVIKNGGYRSIAEAIMKDSEHFSDKISGRYKYRNIKEKDEKGKKESGGKISENDILFPTEMFEDEVRKILGKQKEFYPQLTDESIDKIFDIIFSRRDFEDGPGNTDDENRPYKGFVDSIGNCPYYKNEKRGHRYTVIGDLFALANKLSQYKYVEKNTGEVVKLPRDLMRNIVNQSLQSGSITKTKINELAKEFNIVILNTKTAKNENIADCIKYLKAVKPIFESYGFDWDKLISEEYTDQNSLLNRVGDTISFNITPKRRIDALNKIDELKGKDELIKKLSKQNFSGTAKVSDKYMIDAINAFFDGTLVGEFQANVQQDEFSVSIKTEKLLKLKPFDNNSEYAQNPVVFRAINETRKVVNAIVQKYGAPNAMNIEIASELNKSFDTRQKISTQQNKNEKERKNAIKQISLITGLDEREIRPQYIERYLLGELQGWRCMYSNEEITNKKEAILNKEKQYEIDHIVPFSRVLDDTLNNKTLVLARENQKKGARTPLMYLSAEKEKEFKQRVNKLFKDNKITEKKYRYFMLESLVGEDAEKILGDWKTRNLNDTRYIAKFLVKYFNDNLYFAREKGDDKRPVVYAVKGAITSSLRRQWLNKETWGRYDKGELKKITYFDHAVDAIVIANCLPAYVIIAAENHKLRDIYYSAGKIKTEEYRKSLDNCVDTLMKYYGMSPAVSRKLLEKVKETPSLLKNIRFEVEYRVRDYELMKYFFNYDTKVGEDTLDQIFRNDLYKIYDHQFADSIEMPIVSIKPERKYSGQMVKDGFIKKKDAISGKNSVKTIGENNSTVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEVCSITKKDTVKKFEIDILGKKLGEVKKYGEPLSLLPEKN

SEQ ID NO: 8958 - protein, 1155 aa, unidentified
  REGION 1..1155: note = Description of Unknown:uncultivated organism sequence
MKYLIKYVLGLDIGIGSVGWAVIRCDGDPRIENYGVRIFDSGENEKRKSRASQERRAYRSGRRLIRRRAHRKERIRFWFQKQRLVTVQEIRAYFRGEGKDMIALRVRALDEKISPAELAACMIHISNHRGYREFYELTEEEIAKDEDEQANVSGVQAVRALMKSGKYRTVAEMVARDAAFSAEGIPFPRYRNRKGTAERYVMPREEVKKEARAILEAQQKYHPAVSDAFIEKIMDILFSQRDFEDGPGDADDDSRQYRGFDGSEGHCRFYPDEKRGHRFTFLADEYALVNILSQYRYFDEESGEMTFPAEFARELLAAAVSRGKMQVSDVKATAKKFGLKVVTKAGKKQEPITGAMKFLGPVKPLLEEAGFDWCALTAEDPADMGSLLNRIGETLSVNITPRRRRERLKAIPELAAHPALVEKLTMHRFSGTTNVSNKYMAGAVAAFLEGDIYGKYQDDVNKRESVQAELQGRQYKLAPFGKDFEFYKNPVVMRSINEARKAINRVIEEYGSPYAVNIEVGSELGRSFQMRGEIEAEQRNNEKRRQKAKKEIASLLGRTESEVSSAMLERYFLGEEQNWQCLYSGVPIDKKAALLNADKSFEVDHIVPFSLVLDNTLHNKALVYHKENQTKGQRVPLEYLSGEAQKSFLSRVNLLYRNNKISQKKYKYLTAASAGDTDAIGEWKSRNLNDTRYIARFLVNYLQKNLLFRPSDETDTYRPAVYAVKGAITSQMRRAWLNEYTWGRSDKSELKAVTYLDHAADAIVVACCLPAYVEMTALHRRLRRILKGNGGERNGEYDSVLENAKTYIQKFYHIPAATVEYYLTQRAVRPSLVRDLRREADVRLQDPDTIRFFETEAAKREGRSPHVISDAGAQSKFRADVLAYYRKDREFADRLQMPFTVHIPSRKATGKITDDNAVRIVRRGGEEFKLSRKLVYSLTRADLDNLYTNDEDLRQSLHALLDGAGEKDDVGKLLGERGETQFRTQKGVPVRRVTLRGTAVRTLRKQIDAGNYSDLPDTSYYCVEVYRDGAGKTRTAGIAFSDITVQNGKVCLKESCHRPADYKEHCLYLFTNDYIRVIKKTKKGDEVKFEGYYRSVANINQSAFAYQKYNTPAQRGKVFLIGQNDTVEKFEVDPIGKIGGKIRCGEPLSSAKARG

SEQ ID NO: 8959 - protein, 1412 aa, unidentified
  REGION 1..1412: note = Description of Unknown:uncultivated organism sequence
MDYKGITEAKDKNVTEVKDRAESFMLDKNTNIGIDPGTSSCGYASTNADGSLKVVNGEPLIGTKLYPKGETCEERRVARGGRNNRKHKNKRLQEISNLFRKPVEEKDPHFFDKMKDSWKHPDHRIPETPPHSFHLCDADKKRIPTMSHLIHGLIYNYKDYSDIRYTYTAVYNISSRRGNYLHNGLDEDCTGMCDINEVFESISSVLEDDCNESFPKATDPDKVMDILKNTELAKKEKKKELILCLNLDKSLKKACTFLDLICGSKIKVKALVEDDCSDESICFDDSDYNDKADMYARLLGSEMYKAVEQAKALYDAAILETILQGEEYLCDARVKNYDKHKEDLKLLKKVCKKYGKNVDSEAKDKSGKKIWSDYDKMFHMSKDGECEGIYPTYVNHDTTRKSTVKRGMGGSKKRSKQTFYDAVKNTLTKWDDGNDPDITKILNDIEAGTFMPKQITSQNCVIPIQVQLKMVRKILSNAEMYHPFLLEKNEYGLTVSERIIEWFKFRIEYWMGPLYEESEANGGNGWIIRSKDGEITPWNLSEKIDAEATRKKFIERMVKNCSYLPDKKAMPKESMVYQEFTIHNALNNIKTNNEPLSRSLKADIINDLYKTGRKVSKKKLFNYLNQKGLADSEKEISGIKDDGIGFTMSSYARMHKILGDRLDEPEVYKVAEDIIYYSTIFGLDKSLLEKYIRNNYGRGTVMDFDDDTVEALSKQRFSEWGALSCDFINLEGVRLGTGEKITLIDALRESTYNLMQLINSNDTYDFITTLEARTQKKSGKDIFDVTLDDMSLRYVSNPVKRMTWQAILTVRELIMKTGCIPGKLFIESTRNDGEKEEVQSRGETLKKKYEAIIKGKDNPFEDKKLAAQMLKLLESDIEKDALKNDRLFLWYSQMGFDAYSAKPIAYEVAKKSGSTIVYDRDHIIPQKYRKETSVIDGLVLTKHLFNCDEKKDVYPVDVSIRNNPVIRALWSKLLRYDFMTTEKYNRLIRSTPLTDMEKAEFINAQLVATGQAVMLLKNLFTDLLPGTEVILVKARLVSDFRQEFDIPKSRILNCDHHAHDAYLAIIAGNAHHVKFTKSAYNYIKDADKNKTETYNISKMYKRDIIRNNEVAWKAGPNGTIATVYKSIYEVKPTIRNVAYEGHGKFTDTNPISHRLIKEKTRYLPLKQSGPMSDIYRYGCYRSIKGAYFFIVEYDEKKGSRKTSYEQVPLYLKSRIESDPNGLEKYCEKVLGLKNAVIKNRKVLFGTKLNVDGYHIYITGKTGSNICGTNAEPLRLSREDIRYVQKIEKYVKTGKLDVLISAKKNVEFYDMLVKTLKESVFAKRVGAKSPSFCDTITNGRDKFIALPVIDEKDNRNKVVKRGQLYVLYQILSATSIGGNAADLEAIGGVKSSGIIRCPGASLPVREPSGRVQV

SEQ ID NO: 8960 - protein, 1208 aa, unidentified
  REGION 1..1208: note = Description of Unknown:uncultivated organism sequence
MEIDTKQRILGLDTGTNSLGWAVVDRLPESGYELVDKGVHIFQEGVNIEKGTQEKSRAAERTKYRNQRKQYWRRKVRKILLLQELSNAGLCPFLTSEELRAWRVEGIYPLSNEAFMRWQRTDENKGINPYAARCKCVEQELDMESRQDRYLLGRALYHIAQRRGFLSNRKDQTNDPEKGVIKEGIKELTQKIQDAGCEYLCQYFYQLYQRGERIRSCYTDRKEHYEKEFAAICEKQHLNEALAAKLHKIIFVPRQPKKQQSGIAKCPFEPSKHCAPISHPLFEEFRMWSFIRNIKVQTPEDSELRTLSNEEITKILPLWFRKSKANFNFEDIAKTLAGKGKYCYYKSSEDKPFRFNYHLDSSVAGCPISAQLKGIFSEDILQYRAKVDDIWNALDFYTDDLKLREWGIKHYNLTDEQADALAKIRLPQGYASLSLKAMENIVPLMRDHGMIYSSATLIAKLRDLLNGYDFNEEVRAYLINDIEDYLTVPTDKDGKPLMTREERKQILERKWQTHYHLSDKDLQKLYHPSMIEEYRKVENKTAGVYQLDSPRISAFKNPMAMRSLFRMKAVVNQLLKEGTIDENTIIHIEFSRKLNDANRRAALRRYQTILRDEREKAREAIKPYVPNPSDDDILKYLLWQDQGGKCIYTGKDIHPRELYLGTEYDFEHTVPRSMGGEWTRENLTISDKTFNTETKGSRLPSQLMPQYQQMFAAILQSWKEKYEALDKQVRAEQRKAKTASTKEKKDGFIQSARLKAMQRDFWKNKYEAFTITEDKVSGFTRRQGTDAAIISRYARLYLLSLFNRVDVVQGIITADFRKLWGIQPAYEKKNRENHVHHCIDAITIACIGKREYDLRAASYRAEEEHKIKLVVPKPWIGFTEDIQEIEKEILVAHYTPNPMGKQTNKKLRDSHGHIQYDKRGKVIYSSGATARGALHDDMIYGMIANSHDIDAKHKVGDRCAVKRVPLSAVDVKNVVDPVVKQVIVDAIAKYGNLANAIAAEQENNDGSIWLNKEKNVRLKKVRCFQDFAINAAPIRKLRDVSLKEYKQHQYSRTDGNYVCAIYEGSDNKGNRKRSFEIISNLVAAKAFNTNQPIVPETNEKGYPLIMTLHLGDLVLLYEQSPDELRNASQKELVKRLYKITGMTDSGGLQITMRYQQEARPDKELQQINGLFRADEPIKYLRMLRHTQINAFVQGQDFELTETGKIVFK

SEQ ID NO: 8961 - protein, 1192 aa, unidentified
  REGION 1..1192: note = Description of Unknown:uncultivated organism sequence
MENGSKQRILGIDTGTNSLGWAVVDRLPLGGYELIDKGVQIFQEGVNIEKGTIESSRAAERTSHRSLRKQYWRRKVRKIRLLTVLSNAGLCPPLSVEELRAWRAEGKYPLENEAFMRWQRTDEDKGINPYAARVKCVEQVLDMDNRSDRYLLGRALYHITQRRGFLSNRKDQAGDDDKAAGAVKDGIKDLTQKMQDAGCDYLCQYFYQLYQRGERIRNNYTDRKEHYEKEFDAICKKQNIDEHLCRELHKVIFEQRPLKSQRHGVAKCPFEPAKRCAPVSHPLFEEFRMWSFVRNIKMQTPSDNEPRMLTEGEVNTILHLWYRKSKGTFKFEDIAKALAGKGKYCYYKSAEDKPYRFNYYMDTTIAGCPITAQLREIFAEDILADREQIDTIWHALDFFDDDIKLQEWAITHYNLTEEQAEKFVKIRLPQGYASLSLKAMENIVPIMRDHGMIYSEATLIAKLRDLTKSYPFETDFDDDVETYLKQHLHSQWQEHYGLSDKQISKLYHPSMIEEYQKVEHKTNGVYQLQSPRISALKNPMAMRSLFRMKAVVNQLLKEGKIDENTIVHIEFARKLNDANRRAALRQYQAALKKEKEKAEAAVKEFVPNPTDDDIKKYQLWEEQEGKCIYTNKSISLSALYNGTEFDVEHTIPRSMGGDSTRENLTICDAQFNRAIKCAQLPSQLPNQYQDIILENIQLWKERYEGLDKQIRKISTSGLSTKEAKDRAITRRHLLEMQRDFWRSKYESFIITEDKVQGFTRRQGTDISVISRYGRLFLLSLFPRVDVVKGSMTAAFRKIWGIQSAYEKKNRENHVHHCIDAITIACMGKREYDELSAYYHADEQNRYHNSGIYVPKPWRSFTEDIKYIEKEIFVSHYTPNPMGKQTKKKLRDSKGHILRDNNGQPRYAKGDTARGVLHNDMIYGKITNSHYIDQKHEEGKIYAVKRVTLSEVEPGKVVDPVVRQVILDAITKYGDIKAAIEAEQENSDGAIWFNKEKKVKLKKVRCFQDNAINARPIRSLRDVSDKEYKRCHYSLTNGNFMSAIYEGIDKRDVRRRSFVIISLFEAARAYTQRNSLVPQISKEGYQLKMTLRIGDLVLLYTNTPNEIYNADQKELVNRLYEVTGMSDSGGLQIKLKHHQVAKPSGELKQVNGEYAGSSPVEEYRMLRHSQINALVQGQDFEITDTGKITFLHA

SEQ ID NO: 8962 - protein, 657 aa, unidentified
  REGION 1..657: note = Description of Unknown:uncultivated organism sequence
MEHDYWKGKYDRFVMEEIKEGFKNSQAVDIGIISKYATAYLKSLFNKVYPVKGEMTAEFRKAWGVNITKKGENGRLIKDRDNHIHHCIDAVTIACMNKGKYDKLAHAWGLEDKGDYNTAKKELENEKPWDTFTQDVRNLENEVFIVNQSKDLLPIQTKKKFRKRGKIQPKVIYKKDENGKYVFDTNGKKIVEKYIYKKDDLGNLIPVKGKKLNADLKKTKKEGEDYFKIESENETKFYEYVKDKENEIVYQKDYMIEQGDGTRGSLHKLNYIGVIAKPELENGKPKTENGAFILQKNVNEEVSKFYVKRNPVTKDFSESDIKKIVDEGIKKRIEKHGLKNVKTADGFILLPAEKKGENGSEKDLREMLIKKLRLFEKDKPIEIKRQNEVNLQTEKALRKKHKHHYYAQNDENYCMAIYEGVNDKGKTERAYDLVNNIDASEFFKLSKRKERKDGNISLFPEKHIESEYQLKLQNFKPCILKKGISCILLTDEDEDVEWDNQDWLKSRVYVLTGIDGDGIKLKHNQDARSGADAIKYMNDKVNILKFQSVLPELEKINDIDINSIKADFFNTEIRTKDVFDSIQKQINSYYKENNTLDSKGKLKTLKLKESGLTTPKGGDVIDNYKSFPYVKFKVSGFHAKIENIDFKITPTGKIIKI

SEQ ID NO: 8963 - protein, 1222 aa, unidentified
  REGION 1..1222: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGLCPYLSPELLSQWRLKKVYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAALHQGDSVLLYENSPEEVYNASAAELCRRLYVVSGISSMVITNNKYGVLQLRHSQKAGKYEKGKNGAYVVGENLRSTITMLHTQFKALIQNQDFTIDVLGKIKFLKHD

SEQ ID NO: 8964 - protein, 1222 aa, unidentified
  REGION 1..1222: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKIYPATPEFMQWLGTDDDKAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIDHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKAVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAALHQGDSVLLYENSPEEVYNASAAELCRRLYVVSGISSMVITNNKYGVLQLRHSQKAGKYEKGKNGAYVVGENLRSTITMLHTQFKALIQNQDFTIDVLGKIKFLKHD

SEQ ID NO: 8965 - protein, 1222 aa, unidentified
  REGION 1..1222: note = Description of Unknown:uncultivated organism sequence
METNEKKRILGLDTGTNSIGWAVVDRLGDQCALVDSGVHIFTEGVKEEKGNEVSKAAERTSHRAMRRGFYRRKLRKIRLLRILSELGLCPYLSPELLSQWRLKKIYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDKHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKMYGKKCYGYYKTDGDKDILFNYPMDMGIAGSPFTAGMVAALGSDWKAVIDAQYVKGDNKSLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVLPDDQGRMHLGSPRISAIRNPMAMRSLHRIRHVVNALLDKGLIDHDTEVHIELGRELNDANMRAAIRQQNKHNESERAKAKAVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVSGISSMVITNNKYGVLQLRHSQKAGKYEKGKNGAYVVGENLRSTITMLHTQFKALIQNQDFTIDVLGKIKFLKHD

SEQ ID NO: 8966 - protein, 1222 aa, unidentified
  REGION 1..1222: note = Description of Unknown:uncultivated organism sequence
METNEKKRILGLDTGTNSIGWAVVDRLGDQCALVDSGVHIFTEGVKEEKGNEVSKAAERTSHRAMRRGFYRRKLRKIRLLRILSELGLCPYLSPELLSQWRLKKIYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVSGISSMVITNNKYGVLQLRHSQKAGKYEKGKNGAYVVGENLRSTITMLHTQFKALIQNQDFTIDVLGKIKFLKHD

SEQ ID NO: 8967 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKIYPATPEFMQWLGTDDDKAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIERDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8968 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKVYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKMYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKAVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8969 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKIYPATPEFMQWLGTDDDKAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8970 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKIYPATPEFMQWLGTDDDKAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKMYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKAVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIERDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8971 - protein, 1222 aa, unidentified
  REGION 1..1222: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKVYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAALHQGDSVLLYENSPEEVYNASAAELCRRLYVVSGISSMVITNNKYGVLQLRHSQKAGKYEKGKNGAYVVGENLRSTITMLHTQFKALIQNQDFTIDVLGKIKFLKHD

SEQ ID NO: 8972 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKIYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8973 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGLCPYLSPELLSQWRLKKIYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIDHKTLNRLYHPSDLETYPHVLPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8974 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGLCPYLSPELLSQWRLKKIYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTDSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8975 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKVYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKRYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKVVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8976 - protein, 1214 aa, unidentified
  REGION 1..1214: note = Description of Unknown:uncultivated organism sequence
METNKKKRILGLDTGTNSIGWAVVDRLGDQCALVDSGVHIFTEGVKEEKGNEVSKAAERTSHRAMRRGFYRRKLRKIRLLRILSELGWCPYLSPELLSQWRLKKIYPATPEFMQWLGTDDDNAITPYRYRVICLHEKLDLTQEAQRYILGRALYHMAQRRGFRSNRKDQSNDDEKGKVKEAISDLSHKMKEEGCEYLAEYFEKLYNKGKRIRNQYTSRDNHYVEEFHAICRRQELDEDTIKRLEHVLFDQRPLKSQKHTVGHCLFEPSKSRCQMSHPDFEEMRMLQTINQIRMKTPDDDMLRPLWEDERELIVPLFLRKSKSNFDFEDIAKELAKPYIKMYGKKCYGYYKTDGDKDILFNYPMDMGIAGSPFTAGMVAALGSDWEAVIDAQYVKGDDKGLDDKVNDVWHTLSFFDNDDKLEAWLETNLGLDADTAKKVAGIKMVSAYASLSHKVIRKILPFMRGGMLYSYAVMLANIDAVLPAYVRDNDYMRQAAVDMAVGCLNEYDKKTCECTMYQWLKNFLAEKYHIGHKTLNRLYHPSDLETYPHVRPDDQGRMHLGSPRISAIRNPMAMRSLHRIRHVVNALLDKGLIDHDTEVHIELGRELNDANMRAAIRQQNKHNESERAKAKAVLKDYGVNNVSDDDIAKYILWEEQGKKCLYTGKQIGFECIFGPDPKYDIEHTIPRSRGGDSTMENLTLCDSRFNREVKKTKLPSELANADEVMQRVAFMKEKADDLQKQIRRCRTNASMDKSQKDRIIQKRHSLELQQVYWRNKYRRFEMTEVPEDFSRRQGATAGIVARYARLFLKSLFDDVSIVKGAATADFRKAWKLQSVDEKKSRDNHTHHQVDAVVIACIGRGDYQRLAASYHLNGYADRERPSVPEPWEGFVDDMRRIQAETLVSYDFTDNAPKQVRRRIRFTGSHHIKGHKPSHISESDTARLSLHMDTNYGAIEHDGEVKYVIRKPITELTSQSDIERIVDPIVREKVQAATRGLDKAPEIKTALANPIWMNEAKGIQIKKVRCFTPDVTRPLNVRKNRDISRHEYKRTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 8977 - protein, 1218 aa, unidentified
  REGION 1..1218: note = Description of Unknown:uncultivated organism sequence
MESNEKKRILGLDTGTNSIGWAVIDRLGDQCLLVDSGVHIFTEGVKEEQGKEVSKAAERTSYRAMRRGFYRRKLRKIRLLRILSELGWCPALSPELLSQWRLKKVYPATPEFMQWLGTDDDNAITPYRFRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQREPRKHTVGHCLFEPTKSRCKITHPDFEEMRMLQTLNQIRMKTPDDDMLRPLWDEERKAIIPLFQRKSKSNFYFDDIAKKLAKPYIKRYGEKCYGYYKTDGDKDILFNYPMDMGISGSPFTAGMVAALGPDWKAVIDARYAKGEGKKIDDKVNDVWHALSFFDNDEKLEVWLETNLGIEADTAKKVAGIKMVSAYASLSHKVIRKILPYMREGMIYSYAVMLANIDAVLPAYVRDNDDMRKAAVDMAVECLNEYDKKACECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNNANKQIKAKAAAEISKHFKNFGSSESDMTKALLWAEQVRDIDILKCKLWNEQHAICLYTGKQIGLSDIFGPNPKYDIEHTIPRSRGGDSAMENLTLCDSRFNRDVKKTKLPSELANADEVMQRVAFMKEKADDLQKQIRRCCTNAYMDKSIKDRIIQKRHFLEMQQAYWRNKYRRFEMTEVPEGFSRRQGATAGIVARYARLFLKSLFDDVSIVKGAATADFRKAWKLQSEDEEKSRENHTHHQVDAVVIACIDRGDYQRLAASYHLNGYADRERPSVPEPWEGFVDDMRRIQAGTLISYDFTDNAPKQVRRRIKFTGSHHIKGPKPSHISESDTARLRLHMDTNYGAIERDGEVKYVVRNSIGSLKQKDIKDIVDSVVRQKVQEAYDAKGDAAFSEPIWMNEAKGIQIKKVRCFAPDVKNPLNVRKNRDISRHEYKRTGHFLNDGNYCIAIYEQILPEGSTTKAKRSFLIVNNLAAVSYFKISNRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNQDFTVDVLGKIKFLKHD

SEQ ID NO: 8978 - protein, 1216 aa, unidentified
  REGION 1..1216: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSQSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFGMTEVPEDFSRRQGATAGIVARYARLFLKSLFDDVSIVKGAATADFRKAWKLQSIDEKKSRDNHTHHQVDAVVIACIGRGDYQRLAASYHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKNIVDSVVRQKVQEAYDAKGDVAFSEPIWMNEAKGIQIKKVRCYAPNVTRPLNIRKHRDISRHEYKRTGHFTNDGNYCIAIYEQVLPEGSTAKAKRSFRIVNNLAAASHFKLGNRTNRTELYPPVDENGYRLKAVLHQGDSVLLYEKSPEEIYNASAAELCRRLYVVAGISSTVISNNKYGRLQLRHSQNAGKYESGKNGAYTAGENLRPTITMLHTQLNALIQNQDFTIDVLGKIKFLKHD

SEQ ID NO: 8979 - protein, 1218 aa, unidentified
  REGION 1..1218: note = Description of Unknown:uncultivated organism sequence
MESNEKKRILGLDTGTNSIGWAVIDRLGDQCLLVDSGVHIFTEGVKEEQGKEVSKAAERTSYRAMRRGFYRRKLRKIRLLRILSELGWCPALSPELLSQWRLKKVYPATPEFMQWLGTDDDNAITPYRFRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQREPRKHTVGHCLFEPTKSRCKITHPDFEEMRMLQTLNQIRMKTPDDDMLRPLWDEERKAIIPLFQRKSKSNFYFDDIAKKLAKPYIKRYGEKCYGYYKTDGDKDILFNYPMDMGISGSPFTAGMVAALGPDWKAVIDARYAKGEGKKIDDKVNDVWHALSFFDNDEKLEVWLETNLGIEADTAKKVAGIKMVSAYASLSHKVIRKILPYMREGMIYSYAVMLANIDAVLPAYVRDNDDMRKAAVDMAVECLNEYDKKACECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNNANKQIKAKAAAEISKHFKNFGSSESDMTKALLWAEQVRDIDILKCKLWNEQHAICLYTGKQIGLSDIFGPNPKYDIEHTIPRSRGGDSAMENLTLCDSRFNRDVKKTKLPSELANADEVMQRVAFMKEKADDLQKQIRRCCTNAYMDKSIKDRIIQKRHFLEMQQAYWRNKYRRFEMTEVPEGFSRRQGATAGIVARYARLFLKSLFDDVSIVKGAATADFRKAWKLQSEDEEKSRENHTHHQVDAVVIACIDRGDYQRLAASYHLNGYADRERPSVPEPWEGFVDDMRRIQAGTLISYDFTDNAPKQVRRRIKFTGSHHIKGPKPSHISESDTARLRLHMDTNYGAIERDGEVKYVVRNSIGSLKQKDIKDIVDSVVRQKVQEAYDAKGDAAFSEPIWMNEAKGIQIKKVRCFAPDVKNPLNVRKNRDISRHEYKRTGHFLNDGNYCIAIYEQILPEGSTTKAKRSFLIVNNLAAVSYFKISNRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNQDFTIDVIGKIKFLKHD

SEQ ID NO: 8980 - protein, 1216 aa, unidentified
  REGION 1..1216: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQRIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEERKSIIPLFQRKSKSNFDFEDIAKELAKPYIKRYGKKCYGYYKTDGNKDILFNYPMDMGISGSPFTAGMVAALGPDWKAVIDAQYAKGEGKKLDDKVNDVWHALSFFDNDEKLEVWLETNLGIEADTAKKVAGIKMVSAYASLSHKVIRKILPYMRRGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAELEKYDINNMSETDIDKYLLWDEQKKKCLYTGNQIGIEDIFGPNPKYDIEHTIPRSRGGDSTMENLTLCDSRFNRDVKKTKLPSELANADEVMQRVAFMKEKADDLQKQIRRCRTNASMDKSQKDRIIQKRHSLELQQAYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWEGFVDDMRRIQAGTLISYDFTDNAPKQVRRRIKFTGSHHIKGPKPSHISESDTARLRLHMDTNYGAIERDGEVKYVVRNSIGSLKQKDIKDIVDSVVRQKVQEAYDAKGDAAFSEPIWMNEAKGIQIKKVRCYAPNVTRPINIRKHRDISRHEYKRTGHFINDGNYCIAIYEQVLSEGSTVKAKRSFRIVNNLAAASHFKIGNRTNRTELYPPVDENGYRLKAVLHQGDSVLLYEKSPEEIYNASAAELCRRLYVVAGITSMVISNNKYGRLQLRHSQNAGKYESGKNGAYTAGENLRSTITMLHTQLNALIQNQDFTIDVLGKIKFLKHD

SEQ ID NO: 8981 - protein, 1208 aa, unidentified
  REGION 1..1208: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQKLDEDTVNRLEYVLFDQRPLKSQKHTVGHCLFEPAKSRCQASHPDFEEMRMLQTLNQIRMKTPDDDMLRPLWDEERKAIIPLFQRKSKSNFDFEDIAKELAKPYIKRYGKKCYGYYKTDGDKDILFNYPMDMGIAGSPFTAGMVAALGPDWKAVIDAQYAKGEGKKLDDKVNDVWHALSFFDNDEKLEVWLETNLGIEADTAKKVAGIKMVSAYASLSHKVIRKILPYMRRGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAELEKYDINNVSETDIDKYLLWDEQKKKCLYTGNQIGIEDIFGPNPKYDIEHTIPRSRGGDSTMENLTLCDSRFNRDVKKTKLPSELANADEVMQRVAFMKEKADDLQKQIRRCRTNASMDKSQKDRIIQKRHFLELQQAYWRNKYRRFEMTEVPEDFSRRQGATAGIVARYARLFLKSLFDDVSIVKGAATADFRKAWKLQSSDEKKSRDNHTHHQVDAVVIACIGRGDYQRLAASYHLNGYADRERPSVPEPWEGFVDDMRRIQAGTLISYDFTDNAPKQVRRRIKFTGSHHIKGPKPSHISESDTARLRLHMDTNYGAIERDGEVKYVVRNSIGSLKQKDIKDIVDSVVRQKVQEAYDAKGDAAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRANRTELYPPVDENGYRLKAVLHQGDSVLLYEKSPEEIYNASAAELCRRLYVVTMIWTDGRVNLRYSQYTRAGKGVAGDYKTGELLRPHIMVSSSKFKALIQNQDFIIDVLGKIKFLKHD

SEQ ID NO: 8982 - protein, 1208 aa, unidentified
  REGION 1..1208: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMAAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRSTEVHIELGRELNDANMRAAIRRQNKLNESERAKAKAELEKYGINNVSETDIDKYLLWDEQKKKCLYTGNQIGIEDIFGPNPKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKDIVDPVVRQKVQEAYDAKGDIAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 8983 - protein, 1217 aa, unidentified
  REGION 1..1217: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQETQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMAAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRSTEVHIELGRELNDANMRAAIRRQNKLNESERAKAKAELEKYGINNVSETDIDKYLLWDEQKKKCLYTGNQIGIEDIFGPNPKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSIDEKKSRDNHTHHQVDAVVIACIGRGDYQRLAASYHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQDAYDAKGDVAFSEPIWMNEAKGIQIKKVRCYAPNVTRPLNIRKHRDISRHEYKRTGHFINDGNYCIAIYEQDLPEGSTAKAKRSFRIVNNLAAASHFKLGNRTNRTELYPLVDENGYRLKAVLHQGDSVLLYEKSPEEIYNASAAELCRRLYVVSGISSMVFTKSRSYGVLQLRHSQNASKSEKGKNGAYIVGENLRPTITMLHTQLNALIQNQDFTIDVIGKIKFLKHD

SEQ ID NO: 8984 - protein, 1205 aa, unidentified
  REGION 1..1205: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPPKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDLAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFGMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWENFVDDMRRIQAETLISYDFTDNAPKQVRRRIKFTGSHHIKGPKPSHISESDTARLRLHMDTNYGAIEHDGEVKYVVRNSIVSLKQKDIKDIVDSVVRQKVQDAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTELYPPVDENGYRLKAVLHQGDSVLLYEKSPEEIYNASAAELCRRLYVVTMIKTDGRINFKHSQQAKAKEGLAGDYKIGEVLRPYILVSSSKFKALIQNRDFTIDVLGKIKFLKHD

SEQ ID NO: 8985 - protein, 1216 aa, unidentified
  REGION 1..1216: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWNEERKAIIPLFQRKSQSNFDFEDIAKKLAKPYFKRYGNKCYGYYKTDGDKDILFNYPMDMGISGSPFTAGMIAALGPDWKAVIDAQYAKGEGKKLDDKVNDVWHALSFFDNDDKLEVWLETNLGIDADTAKKVAGIKMVSAYASLSHKVIRKILPYMRGGMIYSYAVMLANIDAVLPAYVRNNDDMRKAAVDMAVECLNEYDKKTCECTMYQWLKNFLAEKYHIDHKTLNRLYHPSDLETYPHVRPDEQDRMRLGSPHISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWEGFVDDMRRIQAETLISYDFTDNAPKQVRRRIKFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRRHRDISRHEYKRTGHFINDGNYCIAIYEQDLPEGSTAKAKRSFRIVNNLAAASHFKLGNRANRTELYPPVDENGYRLKAVLRQGDSVLLYEKSPEEIYNASAAELCHRLYVVAGITSMVISNNKYGRLQLRHSQNAGKYESGKNGAYTAGENLRPTITMYHTQLKALIQNRDFTIDVLGKIKFLKRD

SEQ ID NO: 8986 - protein, 515 aa, unidentified
  REGION 1..515: note = Description of Unknown:uncultivated organism sequence
MENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKDIVDPVVRQKVQEAYDAKGDIAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 8987 - protein, 1216 aa, unidentified
  REGION 1..1216: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQETQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLHQGDSVLLYEKSPEEIYNASAAELCRRLYVVAGITSMVISNNKYGRLQLRHSQNAGKYESGKNGAYTAGENLRPTITMLHTQLNALIQNQDFTIDVLGKIKFLKHD

SEQ ID NO: 8988 - protein, 1216 aa, unidentified
  REGION 1..1216: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRSTEVHIELGRELNDANMRAAIRRQNKLNESERAKAKAELEKYGINNVSETDIDKYLLWDEQKKKCLYTGNQIGIEDIFGPNPKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKNIVDSVVRQKVQEAYDAKGDVAFSEPIWMNEAKGIQIKKVRCYAPNVTRPLNIRKHRDISRHEYKRTGHFTNDGNYCIAIYEQVLPEGSTAKAKRSFRIVNNLAAVSYFKISNRTNRTELYPPVDENGYRLKAVLHQGDSVLLYEKSPEEIYNASAAELCRRLYVVAGISSTVISNNKYGRLQLRHSQNAGKYESGKNGAYTAGENLRPTITMLHTQLNALIQNQDFTIDVLGKIKFLKHD

SEQ ID NO: 8989 - protein, 1032 aa, unidentified
  REGION 1..1032: note = Description of Unknown:uncultivated organism sequence
MSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGIAGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWHNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWENFVDDMRRIQAETLISYDFTDNAPKQVRRRIKFTGSHHIKGPKPSHISESDTARLRLHMDTNYGAIEHDGEVKYVVRNSIGSLKHKDIKDIVDSVVRQKVQEAYDAKGDVAFSEPIWMNEAKGIQIKKVRCYAPNVTRPLNIRKHRDISRHEYKRTGHFTNDGNYCIAIYEQVLPKGSTAKAKRSFLIVNNLAAVSYFKISNRANRAELYPPVDENGYRLKAVLHQGDSVLLYEKSPEEIYNASAAELCSRLYVVAGITSMVISNNKYGRLQLRHSQNAGKYESGKNGAYTAGENLRPTITMLHTQLNVLIQNQDFTIDVLGKIKFLKRD

SEQ ID NO: 8990 - protein, 1208 aa, unidentified
  REGION 1..1208: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMSISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGFSDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKDIVDPVVRQKVQEAYDAKGDIAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKHD

SEQ ID NO: 8991 - protein, 1207 aa, unidentified
  REGION 1..1207: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAELENYGINNASETDIDKYILWDEQHKKCLYTGKQIGIEDIFGPNPKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKNIVDSVVRQKVQEAYDAKGDVAFSEPIWMNEAKGIQIKKVRCYAPNVTRPLNIRKHRDISRHEYKRTGHFTNDGNYCIAIYEQVLPEGSTAKAKRSFRIVNNLAAASHFKLGNRTNRTELYPPVDENGYRLKAVLHQGDSVLLYEKSPEELYNASAAELCRRLYIITSMEADGRINFKQAQLSQSGRKKKEDDKLGFFCPYMRINAKSLNALIQNQDFTIDVLGKIKFLKHD

SEQ ID NO: 8992 - protein, 1205 aa, unidentified
  REGION 1..1205: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDLAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFGMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWENFVDDMRRIQAETLISYDFTDNAPKQVRRRIKFTGSHHIKGPKPSHISESDTARLRLHMDTNYGAIEHDGEVKYVVRNSIVSLKQKDIKDIVDSVVRQKVQDAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTELYPPVDENGYRLKAVLHQGDSVLLYEKSPEEIYNASAAELCRRLYVVTMIKTDGRINFKHSQQAKAKEGLAGDYKIGEVLRPYILVSSSKFKALIQNRDFTIDVLGKIKFLKHD

SEQ ID NO: 8993 - protein, 1194 aa, unidentified
  REGION 1..1194: note = Description of Unknown:uncultivated organism sequence
MPNSSVIFRNIAFAFGLYPEGVKEEQGNEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMAAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRSTEVHIELGRELNDANMRAAIRRQNKLNESERAKAKAELEKYGINNVSETDIDKYLLWDEQKKKCLYTGNQIGIEDIFGPNPKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRKHRDISRHEYKRTGHFINDGNYCIAIYEQDLPEGSTAKAKRSFRIVNNLAVASHFKLGNRANRTELYPPVDENGYRLKAVLRQGDSVLLYEKSPEEIYNASAAELCRRLYVVAGISSMVFTKSRSYGVLQLRHSQNASKSEKGKNGAYIVGENLRPTITMLHTQLNALIQNRDFTINVLGKIKFLKRD

SEQ ID NO: 8994 - protein, 1208 aa, unidentified
  REGION 1..1208: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQETQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSQSNFDFEDIAKELAKPYIKRYGKKCYGYYKTDGDKDILFNYPMDMGISGSPFTAGMVAALGPDWKAVIDAQYAKGEGKKLDDKVNDVWHAVSFFDNDDKLKVWLETNLGIDADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFGMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWENFVDDMRRIQAETLISYDFTDNAPKQVRRRIKFTGSHHIKGPKPSHISESDTARLRLHMDTNYGAIEHDGEVKYVVRNSIVSLKQKDIKDIVDSVVRQKVQDAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLHQGDSVLLYEKSPEEIYNASAAELCRRLYVVTMIKTDGRINFKHSQQAKAKEGLAGDYKIGEVLRPYILVSSSKFKALIQNRDFTIDVLGKIKFLKHD

SEQ ID NO: 8995 - protein, 1208 aa, unidentified
  REGION 1..1208: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQETQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMAAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVINALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFGMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWENFVDDMRRIQAETLISYDFTDNAPKQVRRRIKFTGSHHIKGPKPSHISESDTARLRLHMDTNYGAIEHDGEVKYVVRNSIVSLKQKDIKDIVDSVVRQKVQDAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLHQGDSVLLYEKSPEEIYNASATELCRRLYVVTMIKTDGRINFKHSQQAKAKEGLAGDYKIGEVLRPYILVSSSKFKALIQNRDFTIDVLGKIKFLKHD

SEQ ID NO: 8996 - protein, 1216 aa, unidentified
  REGION 1..1216: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKDIVDPVVRQKVQEAYDAKGDIAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVNENGYRLKAVLHQGDSVLLYEKSPEEIYNASNAELCRRLYVVAGITSMVISNNKYGRLQLRHSQNAGKYESGKNGAYTAGENLRPTITMYHTQLKALIQNRDFTIDVLGKIKFLKRD

SEQ ID NO: 8997 - protein, 1208 aa, unidentified
  REGION 1..1208: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWNEEREAIIPLFQRKSKSNFDFEDIAKELAKPYIKRHGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRTRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQTDIKDIIDSVVRQKVQEAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLHQGDSVLLYEKSPEEIYNASAAELCRRLYVVTMIKTDGRVNLRYSQYTRAGKGVAGDYKTGELLRPHIMVSSSKFKALIQNQDFTIDVLGKIKFLKRD

SEQ ID NO: 8998 - protein, 1205 aa, unidentified
  REGION 1..1205: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFYAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWEGFVDDMRRIQAETLISYDFTDNAPKQVRRRIRFTGSHHIKGPKPSHISESDTARLRLHMDTNYGTIEHDGEVKYVVRNSIGSLKQKDIKNIVDSVVRQKVQEAYDAKGDVAFSEPIWMNEAKGIQIKKVRCYAPNVTRPLNIRKHRDISRHEYKRTGHFTNDGNYCIAIYEQVLPEGSTAKAKRSFRIVNNLAAASHFKLGNRTELYPPVDENGYRLKAVLRQGDSVLLYEKSPEEIYNASAAELCRRLYVVTMIKTDGRVNLRYSQYTRAGKGVAGDYKTGELLRPHIMVSSSKFKALIQNQDFTIDVLGKIKFLKHD

SEQ ID NO: 8999 - protein, 1205 aa, unidentified
  REGION 1..1205: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFYAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKNIVDSVVRQKVQEAYDAKGDVAFSEPIWMNEAKGIQIKKVRCYAPNVTRPLNIRKHRDISRHEYKRTGHFTNDGNYCIAIYEQVLPEGSTAKAKRSFRIVNNLAAASHFKLGNRTELYPPVDENGYRLKAVLRQGDSVLLYEKSPEEIYNASAAELCRRLYVVTMIKTDGRVNLRYSQYTRAGKGVAGDYKTGELLRPHIMVSSSKFKALIQNQDFTIDVLGKIKFLKHD

SEQ ID NO: 9000 - protein, 1225 aa, unidentified
  REGION 1..1225: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSTPNDQSNDDEKGKVKEAISELSQKMKDEGCKYLAEYFEKLYKEGKRIRNQYTSRDSHYVEEFHAICSRQELDEDTVKRLEHVLFDQRPPKSQKHTVGHCLFEPSKSRCQMSHPDFEEMRMLQTLNQIRMKTPEDDMLRPLWENEREKIIPLFQRKSESNFSFKDIAKKLAKIYGKKSYGYYKTDGDKDILFNYPMDMGIAGSPFTAGMVAALGPDWKAVIDAQYVKGDGKSLDDKVNDVWHTLSFHALSFFDNDEKLEVWLETNLGIEADTAKKVAGIKMVSAYASLSHKVIRKILPYMREGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNNANKQIKAKAAAEISKHFKNFGSSESDMTKALLWAEQVRDIDILKCKLWNEQHAICLYTGKQIGLSDIFGPNPKYDIEHTIPRSRGGDSTMENLTLCDSRFNRDVKKTRLPSELANADEVMQRVAFMKKKADELQKQIRRCCTNAYMDKSIKDRIIQKRHFLEMQQAYWRNKYRRFEMTEVPEGFSRRQGATAGIVARYARLFLKSLFDDVSIVKGAATADFRKAWKLQSEDEEKSRENHTHHQVDAVVIACIGRRDYQRLAASYHLNGYADRERPSVPEPWEGFVDDMRRIQAETLISYDFTDNAPKQVRRRIKFTGSQQSEDSKTSYAYDTARLCLHKDTNYGAIKRDGEVKYVIRKPITELKSQGDIERIVDPIVKEKVQAATRGLDKAPEIKAALANPIWMNEAKGIQIKKVRCFAPDVKNPLNVRKNRDISRHEYKRTGHFLNDGNYCIAIYEQILPEGSTTKAKRSFLIVNNLAAVSYFKISNRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNQDFTIDVLGKIKFLKHD

SEQ ID NO: 9001 - protein, 1208 aa, unidentified
  REGION 1..1208: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKFEVWLETNLGIEADTAKKVAGIKMVSAYASLSHKVIRKILPYMRGGMIYSYAVILSNIDAVLPAYVRDNDDMRKAAVDMAVECLNEYDKKTCECTMYQWLKNFLAEKYHIDHKTLNRLYHPSNLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASFHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKDIVDPVVRQKVQEAYDAKGDIAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 9002 - protein, 1216 aa, unidentified
  REGION 1..1216: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGFSDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWSNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPLVDENGYRLKAVLHQGDSVLLYEKSPEEIYNASAAELCRRLYVVAGITSMVISNNKYGRLQLRHSQNAGKYESGKNGAYTAGENLRPTITMLHTQLNALIQNQDFTIDVLGKIKFLKHD

SEQ ID NO: 9003 - protein, 1216 aa, unidentified
  REGION 1..1216: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQDKLNESERAKAKAALKEQGINNASETDIDKYILWDEQHKKCLYTGKQIGIEDIFGPNPKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRKHRDISRHEYKRTGHFINDGNYCIAIYEQVLPEGSTAKAKRSFRIVNNLAAASHFKLGNRTNRTELYPPVDENGYRLKAVLHQGDSVLLYEKSPEEIYNASAAELCRRLYVVAGITSMVISNNKYGRLQLRHSQNAGKYESGKNGAYTAGENLRPTITMLHTQLNALIQNQDFTIDVLGKIKFLKHD

SEQ ID NO: 9004 - protein, 1217 aa, unidentified
  REGION 1..1217: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRVKTPDDDMLRPLWDEEREAIIPLFQRKSKSNFDFEDIAKELAKPYIKRYGNKCYGYYKTDGDKDILFNYPMDMGISGSPFTAGMIAALGPDWKAVIDARYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKNIVDPVVRQKVQEAYDAKGDIAFSEPIWMNEAKGIQIKKVRCYAPNVTRPLNIRKHRDISRHEYKRTGHFINDGNYCIAIYEQVLPEGSIAKAKRSFRIVNNLAAASHFKLGNRTNRTELYPPVDENGHRLKAVLRQGDSVLLYEKSPEEIYNASAAELCRRLYVVAGISSMVFTKSRSYGVLQLRHSQNASKSEKGKNGAYIVGENLRPTITMLHTQLNALIQNQDFTIDVIGKIKFLKHD

SEQ ID NO: 9005 - protein, 1217 aa, unidentified
  REGION 1..1217: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGIEDIFGPNPKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIKFTGSHHIKGPKPSHISESDTARLRLHMDTNYGAIEHDGEVKYVVRNSIGSLKQKDIKDIVDSVVRQKVQEAYDAKGDIAFSEPIWMNEAKGIQIKKVRCYAPNVTRPLNIRKHRDISRHEYKRTGHFINDGNYCIAIYEQDLPEGSTAKAKRSFRIVNNLAAASHFKLGNRANRTELYPPVDENGYRLKAVLRQGDSVLLYEKSPEEIYNASAAELCRRLYVVAGISSMVFTKSRSYGVLQLRHSQNASKSEKGKNGAYIVGENLRPTITMLHTQLNALIQNRDFTIDVLGKIKFLKRD

SEQ ID NO: 9006 - protein, 1217 aa, unidentified
  REGION 1..1217: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTGGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQDKLNESERAKAKAALKEQGINNASETDIDKYILWDEQHKKCLYTGKQIGIEDIFGPNPKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRKHRDISRHEYKRTGHFMNGGNYCIAIYEQDLPEGSTAKAKRSFRIVNNLAVASHFKLGNRANRTELYPPVDENGYRLKAVLRQGDSVLLYEKSPEEIYNASAAELCRRLYVVAGISSMVFTKSRSYGVLQLRHSQNASKSEKGKNGAYIVGENLRPTITMLHTQLNALIQNRDFTIDVLGKIKFLKRD

SEQ ID NO: 9007 - protein, 766 aa, unidentified
  REGION 1..766: note = Description of Unknown:uncultivated organism sequence
MVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVINALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKNIVDSVVRQKVQEAYDAKGDIAFSEPIWMNEAKGIQIKKVRCYAPNVTRPLNIRKHRDISRHEYKRTGHFINDGNYCIAIYEQDLPEGSTAKAKRSFRIVNNLAAASHFKLGNRANRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 9008 - protein, 1216 aa, unidentified
  REGION 1..1216: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFYAICRRQELDEDTVNRLEHVLFDQRPLKSQKHTVGHCLFEPAKSRCQASHPDFEEMRMLQTLNQIRMKTPDDDMLRPLWDEEREAIIPLFQRKSQSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRDTEVHIELGRELNDANMRAAIRRQNKLNESERAKAKAELENYGINNASETDIDKYILWDEQHKKCLYTGKQIGIEDIFGPNPKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRKHRDISRHEYKRTGHFINDGNYCIAIYEQDLPEGSTAKAKRSFRIVNNLAAASHFKLGNRANRTELYPPVDENGYRLKAVLRQGDSVLLYEKSPEEIYNASAAELCRRLYVVAGITSMVISNNKYGRLQLRHSQNAGKYESGKNGAYTAGENLRPTITMYHTQLKALIQNRDFTIDVLGKIKFLKRD

SEQ ID NO: 9009 - protein, 1226 aa, unidentified
  REGION 1..1226: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQREPRKHTVGHCLFEPTKSRCKITHPDFEEMRMLQTLNQIRMKTPEDDMLRPLWENEREMIIPLFQRKSESNFSFKDIAKKLAKIYGKKSYGYYKTDGDKDILFNYPMDMGIAGSPFTAGMVAALGPDWKAVIDAQYVKGDGKSLDDKVNDVWHTLSFHALSFFDNDEKLEVWLETNLGIEADTAKKVAGIKMVSAYASLSHKVIRKILPYMREGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVINALLDKGIIDRGTEVHIELGRELNDANMRAAIRRQNNANKQIKAKAAAEISKHFKNFGSSESDMTKALLWAEQVRDIDILKCKLWNEQHAICLYTGKQIGLSDIFGPNPKYDIEHTIPRSRGGDSTMENLTLCDSRFNRDVKKTRLPSELANADEVMQRVAFMKEKADELQKQIRRCCTNAYMDKSIKDRIIQKRHFLEMQQAYWRNKYRRFEMTEVPEGFSRRQGATAGIVARYARLFLKSLFDDVSIVKGAATADFRKAWKLQSEDEEKSRENHTHHQVDAVVIACIGRRDYQRLAASYHLNGYADRERPSVPEPWEGFVDDMRRIQAETLISYDFTDNAPKQVRRRIKFTGSQQSEDSKTSYAYDTARLCLHKDTNYGAIKRDGEVKYVIRKPITELKSQGDIERIVDPIVKEKVQAATRGLDKAPEIKAALANPIWMNEAKGIQIKKVRCFAPDVKNPLNVRKNRDISRHEYKRTGHFLNDGNYCIAIYEQILPEGSTTKAKRSFLIVNNLAAVSYFKISNRANRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNRDFTIDVLGKIKFLKHD

SEQ ID NO: 9010 - protein, 1208 aa, unidentified
  REGION 1..1208: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISELSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAALKEQGINNASETDIDKYILWDEQHKKCLYTGKQIGFSDIFGPDSKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGKGDYQRLAASYHLNGYADRERPSVPEPWENFVDDMRRIQAETLISYDFTDNAPKQVRRRIRFTGSHHIKGPKPSHISESDTARLRLHMDTNYGAIEHDGEVKYVVRNSIGSLKQKDIKDIVDSVVRQKVQEAYDAKGDVAFSEPIWMNEAKGIQIKKVRCYAPNVTRPLNIRKHRDISRHEYKRTGHFMNGGNYCIAIYEQDLPEGSTAKAKRSFRIVNNLAVASHFKLGNRANRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 9011 - protein, 1203 aa, unidentified
  REGION 1..1203: note = Description of Unknown:uncultivated organism sequence
MESNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIVKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGMIDRDTEVHIELGRELNDANMRAAIRRQNKLNESERAKAKAELENYGINNASETDIDKYILWDEQHKKCLYTGKQIGIEDIFGPNPKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWEGFVDDMRRIQAETLISYDFTDNAPKQVRRRIRFTGSHHIKGPKPSHISESDTARLRLHMDTNYGAIEHDGEVKYVVRNSIGSLKQKDIKNIVDSVVRQKVQEAYDAKGDVAFSEPIWMNEAKGIQIKKVRCYAPNVTRPLNIRKHRDISRHEYKRTGHFTNDGNYCIAIYEQVLPEGSTAKAKRSFRIVNNLAAASHFKLGNRTNRTELYPPVDENGYRLKAVLHQGDSVLLYEKSPEELYNASAAELCRRLYIITSMEADGRINFKQAQLSQSGRKKKEDDKLGFFCPYMRINAKSLNALIQNQDFTIDVLGKIKFLKHD

SEQ ID NO: 9012 - protein, 859 aa, unidentified
  REGION 1..859: note = Description of Unknown:uncultivated organism sequence
MENNEKKRILGLDTGTNSIGWAVIDRLGDQCSLVDSGVHIFTEGVKEEQGKEVSKAAERTSYRAMRRGFYRRKLRKIRLLRILSELGWCPALSPELLSQWRLKKVYPATPEFMQWLGTDDDNAITPYRYRVICLHEKLDLTQEAQRYILGRALYHIAQRRGFRSNRKDQSNDDEKGKVKEAISGLSQKIKDEGCEYLAEYFEKLYKEGKRIRNQYTSRDNHYVEEFHAICRRQELDEDTVNRLEHVLFDQRPLKSQKHTVGHCLFEPAKSRCQASHPDFEEMRMLQTLNQIRMKTPDDDMLRPLWDEEREAIIPLFQRKSKSNFDFEDIAKELAKPYIKRYGKKCYGYYKTDGDKDILFNYPMDMGISGSPFTAGMVAALGPDWKAVIDAQYAKGEGKKLDDKVNDVWHALSFFDNDDKLEVWLETNLGIEADTAKKVAGIKMVSAYASLSHKVIRKILPYMRGGMIYSYAVMLANIDAVLPAYVRDNDDMRKAAVDMAVECLNEYDKKTCECTMYQWLKNFLAEKYHIDHKTLNRLYHPSDLETYPHVRPDEQDRMRLGSPRISSIRNPMAMRSLHRIRHVVNALLDKGIIDRGTEVHIELGRELNDANMRAAIRRQNKLNESERAKAKAALKEQGINNASETDIDKYILWDEQHKKCLYTGKQIGFCDIFGPDSKYDIEHTIPRSRGGDSTMENLTLCDSRFNRDVKKTRLPSELANADEVMQRVAFMKEKADDLQKQIRRCRTNASMDKSQKDRIIQKRHSLELQQTYWRNKYHRFEMTEVPEDFSRRQGATAGIVARYARLFLKSLFDDVSIVKGAATADFRKAWKLQSTDEKKISRQPYAPSSGCSRNRVHRQR

SEQ ID NO: 9013 - protein, 1025 aa, unidentified
  REGION 1..1025: note = Description of Unknown:uncultivated organism sequence
MKDEGCKYLAEYFEKLYKEGKRIRNQYTSRDSHYVEEFHAICSRQELDEDTVKRLEHVLFDQRPPKSQKHTVGHCLFEPAKSRCQASHPDFEEMRMLQTLNQIRMKTPEDDMLRPLWENEREKIIPLFQRKSESNFSFKDIAKKLAKIYGKKSYGYYKTDGDKDILFNYPMDMGIAGSPFTAGMVAALGPDWKAVIDAQYVKGDGKSLDDKVNDVWHTLSFHALSFFDNDDKLEVWLETNLGIDADTAKKVAGIKMVSAYASLSHKVIRKILPYMRGGMIYSYAVMLANIDAVLPAYVRDNDDMRKAAVDMAVECLNEYDKKTCECTIYQWLKNFLAEKYHIDHKTLNRLYHPSDLETYPHVRPDEQDRMRLGSPRISSIRNPMAMRSLHRIRHVVNALLDKGMIDRGTEVHIELGRELNDANMRAAIRRQNKLNESERAKAKAALKEQGINNASETDIDKYILWDEQHKKCLYTGKQIGIEDIFGPNPKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIKFTGSQQSEDSKTSYAYDTARLCLHKDTNYGAIKRDGEVKYVIRKPITELKSQGDIERIVDPIVKEKVQAATRGLDKAPEIKAALANPIWMNEAKGIQIKKVRCFAPDVKNPLNVRKNRDISRHEYKRTGHFLNDGNYCIAIYEQILPEGSTAKAKRSFRIVNNLAVASHFKLGNRANRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKHD

SEQ ID NO: 9014 - protein, 735 aa, unidentified
  REGION 1..735: note = Description of Unknown:uncultivated organism sequence
MKDEGCKYLAEYFEKLYKEGKRIRNQYTSRDSHYVEEFHAICSRQELDEDTVKRLEHVLFDQRPPKSQKHTVGHCLFEPAKSRCQASHPDFEEMRMLQTLNQIRMKTPEDDMLRPLWENEREKIIPLFQRKSESNFSFKDIAKKLAKIYGKKSYGYYKTDGDKDILFNYPMDMGIAGSPFTAGMVAALGPDWKAVIDAQYVKGDGKSLDDKVNDVWHTLSFHALSFFDNDDKLEVWLETNLGIDADTAKKVAGIKMVSAYASLSHKVIRKILPYMRGGMIYSYAVMLANIDAVLPAYVRDNDDMRKAAVDMAVECLNEYDKKTCECTIYQWLKNFLAEKYHIDHKTLNRLYHPSDLETYPHVRPDEQDRMRLGSPRISSIRNPMAMRSLHRIRHVVNALLDKGMIDRGTEVHIELGRELNDANMRAAIRRQNKLNESERAKAKAALKEQGINNASETDIDKYILWDEQHKKCLYTGKQIGIEDIFGPNPKYDIEHTIPRSRGGDSTMENLTLCDSRFNRDVKKTRLPSELANADEVMQHVAFMKEKADELQKQIRRCRTNASMDKSQKDRIIQKRHSLELQQTYWRNKYRRFEMTEVPEDFSRRQGATAGIVARYARLFLKSLFDDVSIVKGAATADFRKAWKLQSTDEKKSRDNHTHHQVDAVVIACIGRGDYQRLAASYHLNGYADRERPSVPEPWKGFVDDMRRIQAETLISYDFTDNAPKQVRRRIKFTGS

SEQ ID NO: 9015 - protein, 1425 aa, unidentified
  REGION 1..1425: note = Description of Unknown:uncultivated organism sequence
MAKILAFDPGTNSLGMVCRDTMSNNLLDQITSGVDIIRDNTESDKRGRHSSAASQRRTFRTARTRYRSVKRRKQATLKLLIKHNCCPLDMESLNKWRFDDDDKGYDRTFPVQNELFMKWINFEFVIDNEVVRSVYRLREILATKALDYSKPESWLMLGRAIYSIAVRRGFKSSRIANVSNEDNEEQLKLQKSEEELSAGLNQYMQEHNCPTVGAAFSRMERVDKIRIRANDDFKPIRNQLKKEIEVIFKVQQRDTDSELYKGLTSEKKHEGTIFYKNPLKSQKGKLEYCTLEPGKRKCAKSHPANEFNVVWQLLNNIKIKLENGWENIPLFMRQTLYDKLFLRNKKHFDFAEIRELLQDEYGIQFEYKESINYSDKKNVPGCPVTFYLQKILGSSWETEKIQGNKKRLKHAQRRKKKFNKEDKRSLKEYTEAEGHLTEYSADDIWHICYESDEKQFVKDFAKDTLGLPPAKVISMGALWEAIQDGYANLSLCALKKINPFLAKGYKYSDAVMLANLPTIMGEAFFLQNEQDIITLIDKERVNISDINRIYDIANKLISDYKSLKMENLAFAEHNCDYTLQEDDIADVKKACAENYGKEWDAATDDQQSTIITRVAELYQEFFFSSNRDYYKRINLFEALKKALTEKYPSLTKNKLKKLYHHSDNAYYPSAQINDDGVLQLGSPARGNLKNPTVLKILYKIKQNVNKLLYSGDIDSDTIIVLENAREALNDFNMRWAIEEYNSKRERENKAIEDALNDLAKEYHLALPKESVTMARLALYQNANFTPYNPNESRRLYDKLCEKYKLWLKQGFFDFYTGRPISLSELFSPDNLVEVDHILPISKSFDNSVSNKVLSSSHYNSVIKGTKLPCELPNYNVDTPEGTAIIKRIHEIEERVMYLEEKVIYWKGRSSKAADPDSKNSAIKQSHLWQMEYDEWNQRLANLTTKEITHSFRNNQLNDTRTISKYAYHYLKSLFGRVVVQRGETTAVFRKIFGFQEAYEKKDRSRHTHHAIDALTLSLIPYGQKRERMMELWYQIQEAHRFKDYDSERSLKDKLDREVHLCGLGHYSPNEVVQYVEDTTLVKNDATNNALTKNIKRYRVRGKVVPMRDENGNIVYEKTAKGIIRVKAKHVSQGNSIRGAIHEQSFYGKIEKWKDDGSHEKEELFVIRRKIEFKSGNAGSGFKSWDDLEKQMVDKKLFKKFKKQYPEGTSFKDACAEGFYTYIVENNRCRRVKVRHVRCLAKAAQPLKKHVFQPQHSDKEQYYYVSPGEAYGVFEYVSKDGERLYESDNLFTLSEKMKNGTLTEIPCPKRITDKKGKEYVHTRTILKDATILIYPSSEREEDQYLLDTVTLSKRLYRINSIEKDRKRLTLTRHNIVKSYAGIETIAESDFYNLPDGMRMPISKLHFLLLESDFDIFDGKIVPIKND

SEQ ID NO: 9016 - protein, 1425 aa, unidentified
  REGION 1..1425: note = Description of Unknown:uncultivated organism sequence
MTKILAFDPGTNSLGMVCRDTMNDNLMEQITSGVDIIRDNTERDKRGRHSSAASQRRSFRNARTRYRSVKRRKQATLKLLIKHNCCPLDMESLNKWRFDDEEKGYDRTFPVHNEEFMKWINFKFFIDGEEVKSVYRLREILVTKPLDFSKPESWLMLGRAIYSIAVRRGFKSSRLANSEINDEENEEGVDLQKSEEELFSGLDQYMKEHNCKTVGAAFARMERVDKIRIRANNDYKPIRSKLKEEIEEIFKVQKRDTDSELYKGLMSEKKHEGTIFYKNPLKSQKGKVEYCTLEPRRRRCPKSHPANEFNTAWQLLNNIKIKRNGLWENITLDIRHKIFNELFVSKEKHFDFVKIREMLQNEYQIQLEYKESINYSDNKSIHGCPIIYYLQKILGPSWETERIPGTNKHLKHAQRRKKLFNKEDKRSIEEYTEAEGHLTEYTYEDIWHICYESDEKQFVKDLAKNVLCLSPSKVISMGALWETIQDGYAKLSLCALKKINPFLAKGYKYSDAVMLANLPTIMGDTFFQQNEQEIIGLMDKERSAILSKNRIYDITNKLISDYKSLKLEGFAFAERADHDYILQDDDIEDVKKACAENFGKEWDALTDNQQSAITTHVKELYQEFFFSKERDYCKRINLADAVKAALAEKYPFLTKKKLKKLYHHSDNFYYPAAHTNENGILQLGNPARGNLKNPTVLKVLYKIKENVNKLLISGDIDADTIIVIENAREGLNDFNMRWAIEEYGKKREKENKAIEDALTDLAKEFHLTLPKGCVSVARLALYQNRDFTPYNPNEPRRLYDKLCENYKLWLRQGFFDFYTGHPITLAQLFSPDNLVEVDHILPVSKSFDDSISNKVLSSTRYNRTIKGTKLPCELPNYNIDTAEGTAIIHRIQDIERKVKYLENKVTYWKGRSSRAANPESKNWAIKQCHLWQMEYDEWNQLLTNLTTREITPSFRHNQLNDTRIISKYAYHYLKSVFGRVVVQRGETTAVFRKIFGFQEIYEKKDRSRHTHHAIDALTLSLIPYGPRRERMMELWYQIQESHRFEDYDTERQLKDKLDREVSLCGLGNYSPTEIVKYIEKTTLVRNDATNNALTKNIKRFRVRGKVVPLRDRDGNVIYEKTSKGIKRVKAKYISQGNSIRGAIHDQSFYGKIEKWKNGKNHEIEEVFVIRKKIEFKSGDKGKGFKSWDDLKAQMVDKKLFDKFEEKEKDFKKACDEGIHICIAENGERRMVRVRRVRCIAKKAQPLKKHIFQPRNDNKERFYYVSSHGEAYGIFEYRSDEGKILYESDSLFTLSTKMKNGEMKEIPCPQHIIRTGKRFVHTRTIRKGDSILIYPEEEKPEDQYKLNTAILSNRLYRVDSIELDKRINLVRHFRGSMPKGKAIKKDADYNNLPEAIRPTLSDKLHFLLLGTDFDILNGKIVPLKND

SEQ ID NO: 9017 - protein, 1201 aa, unidentified
  REGION 1..1201: note = Description of Unknown:uncultivated organism sequence
MDNNGKQRILGIDTGTNSLGWAVVDRLPYGGYELVDKGVQIFQEGVNIEKGTIEKSRAAERTEHRSLRKQYWRRKVRKIRLLAVLSNAGLCPKLTSEELHRWRTDGKYPLQNEEFMRWQQTDENKGINPYAARCRCVEEELDMENRQNRHLVGRALYHIAQRRGFLSNRKEQADEKDNETGKVKSGIKELTQKIQDAGCEYLCQYFYQLYKKGERIRSCYTDRKEHYEKEFAAICEKQHLDEVLSAELYKVMFVPRPLKSQRRGVAKCPFEPSKHCAPLSHPLYEEFRMWDFIRNIKVQTPDNNELRGLTDDEVAKVLPLWYRKSKANFHFEDIAKTLAGKGKYCYYKSAEEKPYRFNFHLDNNVSGCPVSAQLKDIFGEKVLTNRTQVDTIWHALDFFTDDVKLREWGIAHFGLTDEQADAFVKIRMPQGFASLSLKAMENIVPLMRDHRMMYPHATMIAKLRDLTKDYAFDTDFDDDVEAYLKADIEDYLTIPTDKNGKPTISQEERKQVLHNKWKQHYNLSDKDIQRLYHPSMIEAYRKVENKTDGVYQLGSPRISALKNPMAMRSLFRMKAVVNQLLKDGTIDENTIVHIEFARELNDANRRAALRQYQRQLATEREKATEAIKEFVSNPSNDDILKYLLWQDQGGKCVYTGKSISLAALYNGTEFDIEHTIPRSMGGDTTRENLTICDSHFNREIKKNQLPSQLSKQYGDVVLANIETWKEKYEELEKQLRKMKGSTSGLSTKDAKDRVITKRHLLEMQRDFWRNKYNSFVIEEKNVQGFTRRQGTDISVISRYGRLFLLSLFNRVDVVKGSMTAAFRKIWGIQTAYEKKNRENHVHHCIDAITIACMGKREYDELSAYYHADEENRFHNSGQYIAKPWQSFTEDIKDIEKEILVAHYTANPMGKQTKKKLRDNKGHILRDKQDNPIYTTGDTARGVLHMDTQYGAIKQEGEIKYVLRMAIDDSRLKVENIVDSAVRQKVQDAVNQYGSIAKALEAGPIWMNEEKRIAIKKVRVIQDRVQNPMHIRMQRDLSKHKHKRQFHVKNDTNYMVAIYEGENMSQRSYDVVSNLKAVKLLNNNVALFPQIDEKGYHLITCLKVGDMVLLYEKNSEELKTASQQELVKHLFKVVGLALSGGIQIKLNYHQEARPSGDLHQINGPYRFNEPIAARRMLTHSQINALVQGQDFEISDTGKITFK

SEQ ID NO: 9018 - protein, 1231 aa, unidentified
  REGION 1..1231: note = Description of Unknown:uncultivated organism sequence
MDFNSKQRILGLDTGTNSLGWAVVDRVSEGGYELIDKGVSIFQEGVNIEKGTIEKSRAAERTSHRSLRKIYWRRKVRKIRVLAVLSNAGLCPPLSAQELHIWRVEAQYPLNNDAFMRWQRTDENRGVNPYAARCQCIERELDMGDKEDRYLLGRALYHITQRRGFLSNRKNLTEDNDKEKGAVKSSIRELTQKMHDAGCEYLCQYFYQLYQKGERIRSCYTDRKEHYEKEFDAICAKQHLNNTLVKELRKVIFEQRPLKSQRRGIAKCPFEPSKHCAPLSHPLFEEFRMWSFIRNIKIQTPSDSQLRVLTEEEIQQILPLWYRKSKANFHFDEIAKALAGKGNYCYYKSAEDKPYRFNYHLDTNVAGCPISAQLKDVFGTIILKNREEVDKIWQALDFFDDDLKLHEWGIKQYQLTEEQADKLVKIHLPQGYASLSLKAMENIVPLMRDHRMIYSEATLVAKLRDLTKNYSFDSCFDDDVEAYLKSDISEYLEIPTDANGKPLMTREERMNRLYTRWKQHYNLSDKDIQKLYHPSMIEEYRQVETKTNGVYQLGSPRISALKNPMALRSLFRMKAVVNQLLKEGTIDENTIVHIEFARELNDANRRAALRKYQKKLEDERAKAIEAIKAYVPNPSDDDILKYLLYTDQGEKCIYTNRHISLTALYEGTEFDIEHTVPRSMGGATTRENLSICDAKFNREIKKNRLPSQLTEQQQAVMLFNIQTWKNNYEELDKRIRKQKGIISSSSTKEAKDKAIVERHHLEMQRDFWRNKYNSFIIKEEDVQGFTRRQGTDISVINRYGRLYLLSLFNRVDVVKGTMTAAFRKVWGIQQAYEKKNRENYVHHCIDAITIACMGKREYDDLSCFYRAEEENRYHNSGLLIHKPWATFTEDIKQIEQEILIAHHTTNPMGKQTRKKLRNNKGNILRDKQGEVLYSKGDTARGALHNDMIYGKIINSHNMDDKHVTGKICTVKRVILNTITPKDDAKFIAAVVDPVVKQVITEAVAKYGSIRSAIEAEQENNDGTIWFNKAKGVKLKKVRCFQDNAINAQEIRPLRDASDKEYKRYHYSMTNGNYVSAIYEGTDGNGKRKRAFEIFSLFDAAKAYGQKMPIVPKVSKEGYPLIMTLKLGDLVLLYENNPDEIRNASQEEMTKRLYKVTGMSDSNGLQITLRYQQEARDAGTLKTIFGNPKTGLFSSQQEIQPRRMLLHTQINALVQGQHFEISDTGKISFKQC

SEQ ID NO: 9019 - protein, 1203 aa, unidentified
  REGION 1..1203: note = Description of Unknown:uncultivated organism sequence
MENFDKKRILGLDTGTNSLGWAVVDRLPYGGYELIDKGVNIFQEGVNIEKGTIEKSRAAERTEHRSLRKQYWRRKVRKIRLLAVLSNAGLCPPVSSEELHIWRVEGKYPLSNTAFMRWQTTDEKKGINPYAARCRCVEEELDMENRQDRYLVGRALYHITQRRGFLSNRKDQAGEDDKDSGKVKEGIKDLTQKIQDAGCEYLCQYFYQLYKKGERIRSCYTDRKEHYEKEFDAICQKQHLNKELIIALRKVIFEQRPLKSQRRGVAKCPFEPSKHCAPVSHPLFEEFRMWSFIRNIKMQTPSDTELRMLTDEEINKILHLWYRKSKANFQFEEIAKDLAGKGKYCYYKSAEDKPYRFNYYLDTQVAGCPVSAQLKEVFGEAIFANREYIDTIWQALDFFDDDLKLREWGIRHFSLTDEQAKALSDIRLPQGYASLSLKAMENIVPMMRDHGMIYPNATLIAKLRDLTKGYHFATNFDDDVEAYLKSDIEEYLTIPTDNNGKPLVSREERKAALDDKWQRHYNLSDKDIQKLYHPSMIEEYLKVEYRTNGVYQLGSPRISALKNPMAMRSLFRVKAVVNQLLKDGTIDENTIVHIEFARELNDANHRAALRQYQADLRKEREKAVESIKDIVSNPSDDDILRYLLWKDQGGKCVYTGKTISLAALYNGTEFDIEHTVPRSMGGDTTRENLTICDARFNREIKGNRLPSQLSEQDQELLLVNIRSWKEQYEALEKKLRNRKRATSGLSTKEAKDRVIKKHLLEMQCDFWKNKYRAFVVEEKDIQGFTRRQGTDISVISRYGRLYLQSLFNRVDVVKGSMTAQFRKMWGIQTAYEKKNRENHVHHCIDAITIACMGKREYDNLSAYYHADEENRRHNSGLFVAKPWQTFTEDIKDIEKEILVAHYTANPMGKQTRKKLRDSHGHILRDKQNQPLYITGDTARGALHMDTHYGAIRQNGQIKYVLRMAIDDARLKVENIVDPAVRQKVQSAVNQYGSIAKALENGPIWMNEEKQIAIKKVRVYTGISDPLHIRRQRDLSKYEYKRAVHVDNDTNNLFLIYEGLNQKGQLARSFSVLSNIEAAKRYNSKTDQEIIPQINEDGYSLKMIIRVGSLILLYKDKPEELRNLSISSLVKRLYKVIGFGKDGRIKIRYQQEAKEAKELGGFLALDYNTLEVITSQARIGYAKMNALVQGQDFDISDTGKITFK

SEQ ID NO: 9020 - protein, 1113 aa, unidentified
  REGION 1..1113: note = Description of Unknown:uncultivated organism sequence
MKTLSLDLGTAKIGLCLFSENGVLLNSMTISYNDVVVNEKTGGKHTKCSDRRKNRSMRRQYDHERRRKIRLIAFLSKAGYIDGVTHEEMALWRKKQICPEHIIKMLSSKNPYAIRELLTFHKLNMSNEHNRLMFAQAMYSIIGKRGFAEKHGLMLDDNDEDVKESERGKIRKSISELEKKMGETGSKTVGEFMNHQIKSGERIRGEYHTSRKNQIIPEFKMICDMQGISEKMKKELFAIIFSEHKSVRKPHRAKCPFGKNAFVTYDSHPFFEEYRLWQFIRNIRVIDGEDNRVLTDEEVKKAIEFIVIHKNDFDFLELRNELGVEKCNFRDTQRVKVPKFTISLAKVLGKDISELGKYLSEVLGKSEDDALDEVWHRCFDAYRTDGEIGTYFSHHLNCDGVKLDDIEMSDETVNLSASALRKITPWMRDKGLGVSIACRMVNVRRVIKDHIRGGMAKEIIDAMEDRICQSVSHYSYDKDGPLDDFILEEMKKLALDTFPSKKELADKLWHLSLAEKYVAQKSNDGDKLLPVPHELFSNPHIDKSMAIVRRILNMLIKQHKINPDDTKVVLECGRMDSTIVGRIAQDMINKENEKNRKDAEKVLKEKLGCSKVGDEEKERYLLWKEQCGKSLWSGKEIKLENILSEDYEIDHTIARKRGGCNELYNKTLCESSINLKKTNIMPGLMNGIDKVRENVQSLFGPQIDELTEQYDKLSKKIKVSNNEEAKRNARIERIIVKYKLEYLKSKVNTFEAVVEPDGFCATHGHMTDLMVRCMRSWLKSVFRDVSFIRAKDVAEARNNWGLKKDRSTNTNHAQDAFVLCCLDYYGKTKNEPYEGFKDDLECVNSSMTHHVPCKSVKKLTKKKDGRGYGCALSGETQYAIRTDENGKKVTCVHISVNNENFEKNIKNIFNSDMRKRFEEAKDVTNVRDAKGKVVRHVLIKKNLKPENLIKFPRKNSISENENNNMIYYETNGNSCIGYYSNGKHVVLSIADEASGKRLERSIKDKKTSQEHQLKYIIRLGDTVILMKNNETEDDIRKLDTNDLKKRIYRLVGIESDKRIKFLRHDVPSTDNCETFYTNISEIDRTDVKGFRLSNAKLIKDSQIVTKIVFNDYH

SEQ ID NO: 9021 - protein, 1420 aa, unidentified
  REGION 1..1420: note = Description of Unknown:uncultivated organism sequence
MTKILAFDPGTNSLGIICRDSSKDNLIKQITSGVDIIRDNTEREKSGRHSSAASQRRSFRNSRTRYRSVKRRKQATLNLLIKHNCCPLDVESLNKWRFDDDNKGYDRTFPIHNKKFMKWINFEFVIDNEIVRSVYRLREILATKPLDYSKSETRFMLGRAIYSIAVRRGFKSSRLVNSEACEDKDDEDDERVELQKSEEELFAGLNQYMQAHNCPTVGAAFSRMERIDKIRIRANYDYKPIRSELKKEIKKIFEVQKLDIKGEYSELYEGLMSEKKHEGTIFYKNPLKSQKGKVEYCTLEPHKRRCPKSHPDNEFSVAWQLLNNIRIKRNGLWENIALDMRFKIFNDLFVSNKKHFEFAKIREMLQELYHIKFEYRENINYNDKKSVPGCPIIYYLQRILGPSWRTEKIKGTKKHLTHAQRRKKLSVKEKGHLTGYTYEDIWHICYESDEKQFVKDFAKDILALSPSKVLSMGALWEAIQDGYANLSLCALRKINPFLAKGYKYSDAVMLANLPTIMGNDFFLQNEQKIVDMIDKERAAVSETNKIYDITNKLISDYKSLKMEDLAFAEHDFDYTLKEDDIADVKNACAENYGKEWDAMTNDQQSEVVTRVAQLYQEFFFSSKRDYCKRINLSDTLKKDLAEKFPFLTKDKLKKLYHHSDNAYYPSVQANESGILQLGNPARGNLKNPTVLKVLYKIKENVNKLLRNGDIDSDTIVVVENARDALNDFNMRWAIEEYNSKRERENKAIEDALTDFAKEFHFALPKESVQLARLALYQNTNFTPYNPAESRRRYDKLCEKYKLWLRQGFFDFYTGKSISIRELFSPDNLVEVDHILPISKSFDDSISNKVLSSSKYNSSVKGTKLPCELPNYLVDTAEGTAIIHRIHDIEEKVKYLEEKVIYWQGRSSRATDPNLKNSAIKQKHLWQMEYDEWNQRLINLTTKEITPKFRHNQLNDTRTISKYAYHYLKSVFGRVVVQRGETTAVFRKIFGFQEAYEKKDRSRHTHHAIDALTLSLIPYGPKREKMMELWYQIQEAHRFKDYDSERLLKDKIDREIRLCGLGHYSPNEVVKYIEDTTLVRNDATNHALTKNIKRYRVRGKVVPLRDENGNIVYEQTSKGNRRVKAKDVSQGNSIRGAIHDQSFYGKIEKWKDDGSHEKEELFVIRKKIEFKSGNIGNGFKSWEDLEKQMVDKQLFKKFKKQYPGGTSFKEACSGGFYTFVVENGVRRKVKVRHVRCIAMTAQPLKKHIFQPQHSDKEQYYYVSPGEAYGIFEYKNNDGTLHYTLDNLFTLSEKMKNGNLRETPCPQNIMVKGVEFFHTRTILKESTILIYPSTECPEDQYKLKSTTISRRLFRINSIQQDKRIKLTRHNLAKSWTEINTIKDSDFDNLPDGMRMPIAKLHFLLLGTDFDIIDGRIVPIKHD

SEQ ID NO: 9022 - protein, 1425 aa, unidentified
  REGION 1..1425: note = Description of Unknown:uncultivated organism sequence
MTKILAFDPGTNSLGMVCRDTMNNNLMEQITSGVDIIRDNTERDKRGRHSSAASQRRSFRNVRTRYRSVKRRKQATLKLLIKHNCCPLDMESLNKWRFDDDEKGYDRTFPVHNEEFMKWINFKFFIDGEEVKSVYRLREILVTKPLDFSKPESWLMLGRAIYSIAVRRGFKSSRLANSEINDEENEEGVDLQKSEEELFSGLDQYMKEHNCKTVGAAFARMERVDKIRIRANNDYKPIRSKLKEEIEEIFKVQKRDTDSELYKGLMSEKKHEGTIFYKNPLKSQKGKVEYCTLEPRRRRCPKSHPANEFNTAWQLLNNIKIKRNGLWENITLDIRHKIFNELFVSKEKHFDFVKIREMLQNEYQIQLEYKESINYSDNKSIHGCPIIYYLQKILGPSWETERISGTNKHLKHAQRRKKLFNKEDKRSIEEYTEAEGHLTEYTYEDIWHICYESDEKQFVKDFAKNVLCLSPSKVISMGALWEAIQDGYAKLSLCALKKINPFLAKGYKYSDAVMLANLPTIMGDTFFQQNEQEIIGLMDKERAAILSKNRIYDITNKLISDYKSLKLEGFAFAERADHDYILQDDDIEDVKKACADNFGKEWDALTDNQQSAITTHVKELYQKFFFSKERDYCKRINLADAVKAALAEKYLFLTKKKLKKLYHHSDNSYYPAAHTNENGILQLGNPARGNQKNPTVLKVLYKIKENVNKLLISGDIDADTIIVIENAREGLNDFNMRWAIEEYGKKREKENKAIEDALTDLAKEFHLTLPKGCVSVARLALYQNRDFTPYNPNEPRRLYDKLCENYKLWLRQGFFDFYTGHPITLAQLFSPDNLVEVDHILPVSKSFDDSISNKVLSSTRYNRTIKGTKLPCELPNYNIDTAEGTAIIHRIQDIERKVKYLENKVTYWKGRSSRAANPESKNWAIKQCHLWQMEYDEWNQLLTNLTTREITPSFRHNQLNDTRIISKYAYHYLKSVFGRVVVQRGETTAVFRKIFGFQEIYEKKDRSRHTHHAIDALTLSLIPYGPRRERMMELWYQIQESHRFEDYDTERQLKDKLDREVSLCGLGNYSPTEIVKYIEKTTLVRNDATNNALTKNIKRFRVRGKVVPLRDKDGNVIYEKTSKGFKRVKAKYVSQGNSIRGAIHDQSFYGKIEKWKNGKNHEIEEVFVIRKKIEFKSGDKGKGFKSWDDLKAQMVDKKLFDKFEEKEKDFKKACDEGIHICVAENGERRMVRVRRVRCIAKKAQPLKKHIFQPGNDNKERFYYVSSHGEAYGIFEYRSDEGKILYESDSLFTLSTKMKNGEMKEIPCPQHIIRTGKRFVHTRTIRKGDSILIYPEEEKPEDQYKLNTAILSNRLYRVDSIELDKRINLVRHFRGSMPKGKAIKKDADYNNLPEAIRPTLSDKLHFLLLGTDFDILNGKIVPLKND

SEQ ID NO: 9023 - protein, 1225 aa, unidentified
  REGION 1..1225: note = Description of Unknown:uncultivated organism sequence
MENVIKQRILGLDTGTNSLGWAVVDRLPLGGYELVDKGVQIFQEGVNIEKGTQEKSRAAERTSHRSLRKLYWRRKVRKIRLLTVLSNAGLCPSLTSQELRAWRMNGKYPLNNIAFMRWQLTDEQKGINPYAARCRCVEEELDMSSPDNRYLVGRAMYHIAQRRGFLSNRKDQTDDKDKESGAVKAGIKELTQKIHDAGCEYLCQYFYQLYQKGERIRSCYTDRKEHYEHEFDAICAKQHLDESLVQQLRKAIFEQRPLKSQRRGVAKCPFEPSKHCAPVSHPLFEEFRMWSFIRNIKMQTPEDAELRMLTNEEIDKVKHLWFRKSKANFPFEDIAKTLAGKGKYCYYKSAEDKPYRFNYYMDTSVAGCPVSAQLRDVFGEDLLKDRAQVDSIWLALDFFDDDLKLREWAIKHYNLADEQADAFVKIRLPQGYASLSLKAMENIVPLMRDHGMNYPNATLLAKLRDLTKDYPFEKDFDEDVEAYLKADIEEYLTIPTDKNGKPLMSREERKEALDVKWMQHYNLSAKEIKKLYHPSMIEEYRHVEHTTNGVYQLGSPRISALKNPMAMRSLFRMKAVVNQLLKDGTIDENTIIHIEFARELNDANRRAALRRYQAALRKEREDAVEAIKEFIPNPSDDDVLKYLLWKDQEGKCVYTGKSISLSALYNGTEFDIEHTVPRSMGGDTTRENLTICDAKFNREIKKNRLPSQLSEQAQELLQANIQTWKENCEALDKQLRKMKNATSGLSTKEAKDSVIAKRHLLEMQRDFWRNKYKAFTIEEKDVQGFTRRQGTDISVISRYGRLYLLSLFNRVDVVKGSMTAAFRKIWGIQTAYEKKNRENHVHHCIDAITIACMGKREYDELSAYYHADEENKYHSSDILMPKPWKTFTEDIKDIEQEILVAHYTSNPMGKQTKKKLRDSRGHIIRDANKQPRFAQGDTARGALHNDMIYGMIVNSQNVDDKHKVGNLCAVKRIILSSVASKDEEKMAASIVDPIIKKTVNDARAKYGSLSAAIEAEQENGDGSIWLNKEKNVKIKKVRCFQDFAINASPIRSLRDQSKKEYKRSHYSMTNGNFMSAIYEGTDAKGKKKRSFVIISLYEAAQAYGKHEPLVPTVSEEGYALIKTIRLGDLVLLYENSPEEIYTASQEELVKRMYEIIGMSDSKGLQIRLKHQQEARPNGELQQINGAFKNGDSAPIRMLLHTQFNALVQGQDFNISDTGKITFKSC

SEQ ID NO: 9024 - protein, 1231 aa, unidentified
  REGION 1..1231: note = Description of Unknown:uncultivated organism sequence
MENTIKQRILGIDTGTNSLGWAVVDRLPMGGYELVDKGVQIFQEGVNIEKGTQEKSRAAERTSHRSLRKQYWRRKIRKIALLKKLSEAGLCPPLSNEELHAWRVNGVYPLTNDAFMRWQRTDENKGLNPYAARCQCIEMMLNMDNPAERHILGRALYHIAQRRGFLSNRKSQTDDKDTGVVKDGIKDLTQKIQDAGCEYLCQYFFQLYQRGERIRSCYTDRKEHYEKEFEAICKKQHLKEDLVSELHKIIFVPRPLKSQRRGVAKCPFEPSKHCAPISHPLFEEFRMWSFIRNIKIQTPEDSELRILTEGEINKVLHLWFRKSKKNFSFEDIAKAIAGKGKYCYFKSTDDKPYRFNYHMDTSVAGCPVSAQLIEVFGEAILTKREEVDKIWQALDFYDDDQKLREWGIKHYDLSEEQANMLAEIHLPQGYAALSLKAMENIVPLMRDHKMIYPNATLIAKLRDLTKDYPFDKDFDDDVEAYLKADIEEYLFIPKDENGKPLQSREERREDLEYKWRIHYHLSDKDLKKLYHPSMIEEYRHVDHTTNGVYQLGSPRISALKNPMVMRSLFRLKAVVNQLLKDGTIDENTIIHIEFARELNDANRRTALRHYQTALRKEREEAVEAIKDYVPYPSDDDILKYLLWMDQGGKCVYTGKSISIASLGKCTYTGRDIDLSALYNGTDFDIEHTIPRSMGGETTRENLTICESRFNREIKRNQMPSQLPQQYREVVLSNIKPWKEKYEELDKQLRKMKNASSGLSTKDARDRVVAKKRLLEMQRDFWRNKYNAFIIEENDVKGFTRRQGTDISVISRYGRLYLQSLFGRVDVVKGSMTAAFRKIWGIQSAYEKKNRENHVHHCIDAITIACMGKREYDELSAYYHADEENKYHTSDILMPKPWKTFTEDIKDIEQEILVAHYTSHPMGKKTKKRLRDNKGHIICDADKQPLYAQGDTARGALHNDMIYGMITNSQDVDDKHPAGKQCAVKRISLKEVDEKQVVDPIVKQVIMDAIAKYGNISAAIEAEQENGDGSIWLNHEKGVKLKRVRCFQDFAINASPIRPLRDLSLKEYKRSHYSLTNGNYMAAIYEGIDDKGKTKRTFEIISLFEAAQAYSKNAPLVPQTKDGYPLIKTIRLGDLVLLYEKSPEEIYYASREDLVKRLYEIVGMSDSGGLQIKLKYQQEAKPAGELKQVNGAFTANAPIDSFRMLRHSQFNALVQGQDFDISDTGKITFRSC

SEQ ID NO: 9025 - protein, 1222 aa, unidentified
  REGION 1..1222: note = Description of Unknown:uncultivated organism sequence
MENVNKQRILGLDTGTNSLGWAVVDRLPLGGYELVDKGVQIFQEGVNIEKGTQEKSRAAERTSHRSLRKIYWRRKVRKIQLLKLLSEKGLCPELSKEELRAWRMEGKYPLNNIAFMRWQQTDEQKGINPYAARCKCVEEELDMSNPDDRYLVGRALYHIAQRRGFLSNRKDQTDEKDKESGAVKAGIKELTQKIHAAGCEYLCQYFYQLYQKGERIRSCYTDRKEHYEHEFDAICAKQHLDEALVQQLRKAIFEQRPLKSQRRGVAKCPFEPSKRCAPISHPLFEEFRMWSFIRNIKIQTPEDADLRMLTDDEIDKVKHLWFRKSKPNFPFEDIAKTLAGKGKGQYNYYKLAKDEPYRFNYYMDTSVAGCPVSAQLREVFGEELLKDRAQVDAIWLAVDFFDDDLKLREWAIKHYNLTGEQADAFVKIRLPQGFASLSLKAMENIVPLMRDHGMIYPNATLVAKLRDLTKDYAFEKNFDEDVEAYLKADIEEYLTIPTDKNGKPLMTREERKEALDVKWMQHYNLSVKDIKKLYHPSMIEEYRHVELTTNGVYQLGSPRISALKNPMAMRSLFRMKAVVNQLLKDGTIDENTIIHIEFARELNDANRRAALRRYQAALRKEREDATAAIKEFILNPSDDDILKYLLWKDQEGKCVYTGKSISLSALYNGTEFDIEHTVPRSMGGDTTRENLTICDAKFNREVKKNRLPSQLSEQAQELLQNNIKTWKENYEALDKQLRKMKNATSGLSTKEAKDSVIAKRHLLEMQRDFWRNKYKAFTIEEKDVQGFTRRQGTDISVISRYGRLYLLSLFNRVDVVKGSMTAAFRKIWGIQTAYEKKNRENHVHHCIDAITIACMGKREYDELSAYYHADEENKYHSSDILMPKPWKTFTEDIKDIEQEILVAHYTSNPMGKQTKKRLRDSRGRIIRDANKQPLFAKGDTARGALHNDMIYGMIVNSQNVDDKHPEGKMCAVKRVALKDVDVKQVVDPIVRKVIMDAIAKYGNISAAIDAEQESGDGAIWLNKEKGVKIKKVRCFQDFAINASPIRSLRDQSKKEYKRSHYSMTNGNFMSAIYEGLDAKGKKKRSFVIISLFEAAQAYGKREPLVPKVSKDGYALIKTIRLGDLVLLYENSPKEIYNASQEELVKRMYEIVGMSDSGGGLQITLKYQQEAKPNGELKQVNGAFAADAPIANFRMLRHTQFNALVQGQDFDISDTGKITFRSC

SEQ ID NO: 9026 - protein, 1208 aa, unidentified
  REGION 1..1208: note = Description of Unknown:uncultivated organism sequence
MEIGNKQRILGLDTGTNSLGWAVVDRLPESGYELVDKGVHIFQEGVNIEKGTQEKSRAAERTKHRNQRKQYWRRKVRKILLLQELSNAGLCPFLTPEELRAWRVEGIYPLSNEAFMRWQRTDENKGINPYAARCKCVEQELDMENRQDRYLLGRALYHIAQRRGFLSNRKDQTNDPEKGVIKEGIKELTQKIQDAGCEYLCQYFYQLYQRGERIRSCYTDRKEHYEKEFAAICEKQHLNEALAAKLHKIIFVPRQPKKQQSGIAKCPFEPSKHCAPISHPLFEEVRMWSFIRNIKVQTPEDSELRTLSNEEITKILPLWFRKSKANFNFEDIAKALAGKGKYCYYKSSEDKPFRFNYHLDSSVAGCPISAQLKGIFSEDILQDRAKVDDIWNALDFYTDDLKLREWGIKHYNLTDEQADALVKIRLPQGYASLSLKAMENIVPLMRDHGMIYPNATLIAKLRDLLNGYDFNEEVRAYLINDIEDYLTVPTDKDGKPLMTREERKQILERKWQTHYNLSDKDLKKLYHPSMIEEYRKVENKTNGVYQLDSPRISALKNPMAMRSLFRMKAVVNQLLKEGTIDENTIIHIEFSRKLNDANRRAALRRYQTILRDEREKAREAIKPYVPNPSDDDILKYLLWQDQGGKCIYTGKDIHPRELYLGTEYDFEHTVPRSMGGEWTRENLTISDKTFNTETKGSRLPSQLMPQYQQMFAAILQSWKEKYEALDKQVRAEQRKAKTASTKEKKDGFIQSARLKAMQRDFWKNKYEAFTITEDKVSGFTRRQGTDAAIISRYARLYLLSLFNRVDVVQGIITADFRKLWGIRPAYEKKNRENHVHHCIDAITIACIGKREYDLRAASYRAEEEHKIKLVVPKPWIGFTEDIQEIEKEILVAHYTPNPMGKQTKKKLRDSHGHIQYDKRGKVIYSSGATARDALHDDMIYGMIANSHDIDAKHKVGDRCAVKRVPLSAVDVKNVVDPVVKQVIVDAIAKYGSLANAIAAEQENNDGSIWLNKEKNVRLKKVRCFQDFAINAAPIRKLRDVSLKEYKQHQYSRTDGNYVCAIYEGSDNKGNRKRSFEIISNLVAAKAFNTNQPIVPETNEKGYPLIMTLHLGDLVLLYEQSPDELRNASQKELVKRLYKITGMTDSGGLQITMRYQQEARPDKELQQINGLFRADEPIKYLRMLRHTQINAFVQGQDFELTETGKIVFK

SEQ ID NO: 9027 - protein, 1410 aa, unidentified
  REGION 1..1410: note = Description of Unknown:uncultivated organism sequence
MSKILAFDPGTNSLGMVLRDTDNGNLADQVTSGVDIFRDKTERDKRGRHHSAASQRRSFRNARTRLRSVKRRKQATLKLLIKHGCCPLDMDSLNKWRFDDDEKDYDRTFPVSNESFMNWINFEFQIGNEKVRSVYRLREILATTPLDYSKPESWLMLGRAIYSIAVRRGFKSSRLDSTKSDDTENDDIQQLQKSEEELSKGLSAYMTEHNCPTVGAAFARMERVDRIRIRANEDFKPIRAMLKKEIETIFDVQRLDTDSDLYKGLMSEKKHEGTIFYKNPLKSQKGKIEYCTLEPHRRRCPKSHPANEFNVAWQLLNNIKIKREGVWEFLDIQVRHTLYQELFVRNVKHFDFKEIREKLEDIYNLTLEYRESINYSDTKSVNGCPISHYLQKIFGPDWQSVEIPGTKKHLTHADRRKGLKLDEAGHQTKYTAEDIWHICYESDEKEFVKDYADKLGLSSRYMGALWENIQDGYSNLSLCALRKINPFLERGYKYSDAVMLANLPTIMGKEAFEQHEQEILHLIEDERARIAAINRDYDIANKLISEYKSLQLEGLAFAERDYDYTLKEDDIAAVKAACAENYGREWDTMPDGDKDVLITHIAHLYQDFFFSKKRDYYKRINLSDSLKSVMMEQFPFLSKGKLNKLYHHSDNAYYAPAKYGDDGIPQLGSPAKASLANPNVLKVLYKMKQNVNKMLKNRDIDSDTIVVVENAREALNDFNMRWAIEEYNNKREREHKYIEKALNELSAELGFTVPKESVQMARLALYQNENFTPYNPNEPHKFYDKLFEKYKLWLRQGFIDFYTGRPISLTELFSENNLVEVDHILPISKSFDDSISNKVLSSSRYNSGVKGTKLPCQLPNYQVDTPEGTAIIHRIDDIREKVKYLENKVDYWKGRSSRAADPDSKNSAIKQMHLWQMEYDEWNKRLINLTATEITPKFRSSQLNDTRIISKYAYHYLKTVFGRVVVQRGETTAVFRKIFGFQSAYEKKDRSRHTHHAIDALTLSLIPYGPKRERMMELFYEKQEAHRFKDYALEKQLQARLDSEIRFCGLGQYSPDEIVKHIEETTLVKNDATNNALTKNVKRYRVRGKVVPQRDANGNVIYEHTPKGKRVKAKHVSQGDSIRGAIHDQTFYGKISKWKDDGSHENEEQFVLRRKIEYKSGDNGSGFKSWEDLRDHMVDQKLFEQLKKNAEGKDFQKACAEGLFVYVAENGEKKKIRVRHVRCKAKTAQPLKKHIFQPKDKHVDQYYYVSSHGEAYGVFEYKSKDGKLIYESDSLFTLSQKMKLGELKELPCPKHIIRKGKDYFYTRSILKEDTILVYPSKEKPEDQFSLEPKEISMRLYRVDSVSIDKRLSLTRHIFSGGLPRGNAFKESDFEHLPETIRPTVSDKLHFLVLGTDFDIINGRMVQKTDE

SEQ ID NO: 9028 - protein, 1415 aa, unidentified
  REGION 1..1415: note = Description of Unknown:uncultivated organism sequence
MSKILAFDPGTNSLGMVLRDTDNGNLADQVTSGVDIFRDKTERDKRGRHHSAASQRRSFRNARTRLRSVKRRKQATLKLLIKHDCCPLDMESLNKWRFDDDEKGYDRTFPVDNEAFMNWINFEFQIGSEKVRSVYRLREILATTPLDFSKPESWLMLGRAIYSIAVRRGFKSSRLDSAKSDDAENDDTQQLQKSEEELSKGLSAYMTEHNCPTVGAAFARMERVDRIRIRANEDFKPIRAMLKKEIETIFAVQQLDTDSDLYKGLMSEKKHEGTIFYKNPLKSQKGKIEYCTLEPHRRRCPKSHPANEFNVAWQLLNNIKIKRDGIWEFLDIQVRQTLYQELFVRNVKHFDFKEIREKLEDIYNLTLEYRESINYSDTKSVNGCPITHYLQKILGPDWQNEKIPGTKQHLTHADRRKGLKLEEAGHQTTYTAEDIWHICFESDEKQFVKDFAKNELNLPTAKVNSMGALWENIQDGYSNLSLCALRKINPFLERGYKYSDAVMLANLPTIMGKETFEQHEQEILHLIEDERARIAATNRDYDIANKLISEYKSLQLEGLAFAERDYDYTLKEDDIDAVKAACAENYGREWDTMPDGDKDVLITHIAHLYQDFFFSKKRDYYKRINLSDSLKSVMMEQFPFLTKGKLSKLYHHSDNAYYAPAKCGDDGIPQLGSPAKASLANPSVLKVLYKIKQNVNKMLKSGDIDTDTIVVVENAREELNDFNMRWAIEEYNNKREREHKYIEKALNELSAELGFTVPKESVQMARLALYQNENFTPYNPNESHKFYDKLFERYKLWLRQGFIDFYTGRPISLTELFSENNLVEVDHILPISKSFDDSISNKVLSSSRYNSGVKGTKLPCELPNYRVDTPEGTAIIHRIDDIREKVKYLENKVDYWKGRSSRAADPDAKNSAIKQMHLWQMEYDEWNKRLTNLTTTEITPKFRSSQLNDTRIISKYAYHYLKTVFGRVVVQRGETTAVFRKIFGFQSAYEKKDRSRHTHHAIDALTLSLIPYGPKRERMMELFYEKQEAHRFKDYELEKQLQARLDSEIRFCGLGQYSPDEIIKHIEETTLVKNDATNNALTKNVKRYRVRGKVVPQRDADGNVIYEKTPKGKRVKAKHVSQGNSIRGAIHDQTFYGKISKWKDNDVSHEKEELFVLRRKIEYKSGDIGNGFKSWDDLKKQMVDQKLFEQLKKNAEGKDFQTACAEGLFVYVVENGEKRKVRVRHIRCKAQTAQPLKKHIFQPKDKHVEQYYYVSPGEAYGIFEYKSSDGKFIYETDNLFSLSMKMKNGELKELPCPKHIIRKGKEYTHTRTILKENTILVYPPKEQQEDQFKLTPAEISKRLYRINSIELPNRIKLTRHNLAESFKGRDTITDDDFNNLPDGFRKSVTTLKFLLLGKDFDIINGKMVPISKTDE

SEQ ID NO: 9029 - protein, 1218 aa, unidentified
  REGION 1..1218: note = Description of Unknown:uncultivated organism sequence
MEIDTKQRILGLDTGTNSLGWAVVDRLPEGYKLVDKGVQIFQEGVTIENGNQEKSRAAERTKQRSLRKQYWRRKVRKIFLLQELSNAGLCPPLSLEELHRWRVEGIYPLSNEPFMRWQRTDENKGVNPYAARCQCIERELDMENKNDRYLLGRALYHIAQRRGFLSNRKNQTDNKETGVVKEGIKELTQKINDAGCEYLCQYFYQLYQRGERIRSCYTDRKEHYEKEFAAICEKQHLNGALVEKLYKIIFVPRPPKKQNNAIAKCPFEPSKHCAPISHPLFEEFRMWSFIRNIKVQTPDDTNLRALSADEISKIQQLWYRYKKGQTNYNFHFEEIAKALAGKGKYCYYKSAEAKPYRFNYYLDTNVAGSPVSAQLKDIFGENILQDREALDKIWNALDFYTDDVKLSEWGIKHYNLTDEQADKLAQMRLPEGYASLSLKAIENIMPLMRGHGLMYSSATLIAKLRDLLKGYDFDEEVDAYLINDIEDYLTIPTDKNGKPLMSREERKQILDRKWQTHYNLSDKDLKKLYHPSMIEAYPKVEDKTDGVYQLKSPRISALKNPMAMRSLFRIKAVVNQLLKEGSIDENTIVHIEFSRSLNDANRRAALLSYQTILRDERESAREEIKKYVPNPTDDDILKYLLWKDQGGVSVYTGKPIPPDLLFKGDQYNFEHTVPRSMGGEWTRENLTICEQHFNTDIKGSQLPSQLSEQYKQIFEEQIQAWKDKYEDLDKQIRKLQKQSSGATTKEAKDGIIKKIRLLQLQSKFWHNKYEAFIIEEDKVKGFTRRQGTDISVINKYGRSFLQTLFERVDVVKGTMTAAFREVWDIQEPYEKKDRTNHVHHCIDAITIACMGKREYDKLSEYCHEEEENRHRLHGVRLPKPWPTFTEDIQEIEKEILVSHFTPNPMGKQTKKKLRDSRGHIICDKDKQPLYAAGDTARVVLHNDKIYGKILNSHDIDPKHPSGKECTVKRIPLAEVKVNEVVDPVVKQVIANAIAKYGSIKAAIEAEQENQDGSIWLNKEKNVRLKKVRCFQDFASGAEPIRALRDMSAKEYKRFHYSRPDGNYVAAIYEGTDKKGNRKRTSVIVTNLDAAKAFNKHQPLVPETKEGYALLCTIKKGDLVLLYENSPEELRNATQAELSKRLYKIAKMYDSGGLQITIRHHQEAREATKLKELYGNPKTGLFDSSQEIYPQRRLSYNQFNALVQGQHFELTETGKIVFK

SEQ ID NO: 9030 - protein, 1403 aa, unidentified
  REGION 1..1403: note = Description of Unknown:uncultivated organism sequence
MNDNLMDQITSGVDIIRDNTETDRRGRHSSAASQRRTFRTARTRYRSVKRRKQATLKLLIKHSCCPLDMESLNKWRFDDDCKGYDRTFPVHNEAFMKWINFEFVIDGETVRSVYRLREILATKPLDFTKPESWLMLGRTIYSIAVRRGFKSSRLANASDADDEELPELQASEAELSKGLNQYMLDHNCPTVGAAFSRMERVDKIRIRANNDYKPIRKQLKEEIEVIFKVQQLDTDSELYKGLVSEKKHEGTIFYKNPLKSQKGKVEYCTLEPRKRKCAKSHPANEFNVAWQLLNNIKIKRDGLWENISLDIRKAIFDKLFVRNKKHFDFVEIRELLQDEYGILLEYKESINYSDKKSVPGCPVTYYLQKILGPSWETEKIQGNKKHLKQAQRRKKQFDKDDNRNLKEYTEAEGHLTEYTYEDIWHICYESDEKQFVKDFAKDVLGLTPAKVISMGALWENIQDGYANLSLCALKKINPFLAKGYKYSDAVMLANLPTIMGGAFFKQNEQDIVNLIDEEKTAISDANRIYDIANKLISNYKALKMEGYAFAEHNCDYTLQEDDINDVKKACAENYGKVWETMTDVQQSEVITRVADLYQEFFFSSKRDYYKRINLSEALKNALAEKFPSLTKNKLKKLYHHSDNAYYPSAQTNEDGILQLGSPARGNLRNPTVLKVLYKIKQNVNKLLLSGDIDSDTIIVVENAREALNDFNMRWAIEEYNSKRERENKAIEDALNDLAKEFHLTLPKECVPMARLALYQNANFKPYNPNESRRLYDKLCEKYKLWLKQGFFDFYTGRPISLSELFSPDNLVEVDHILPISKSFDDSISNKVLSSSRYNSSIKGTKLPCELPNYSVDTAEGTAIIHRIDEIKEKVKYLEDKVFYWKGRSSRAADPDSKNSAIKQMHLWQMEYDEWNQRLTNLTAKEITPSFRNNQLNDTRTISKYAYHYLKSVFGRVVVQRGETTAVFRKMFGFQDAYEKKDRSRHTHHAIDALTLSLIPYGPKREKMMELWYQIQEAHRFKDYVQERQLKDRLEREKALCGLGRYSPDEVVRYIEETTLVRNDATNHALTKNIKRYRVRGKVVPLRDESGNIVYEKAAKGIKRVKAKYVSQGNSIRGAIHDQSFYGKIEKWKDDGSHEMEELFVIRRKIEFKAGSVGSGFKSWDDLEKQMVDKKLFKKFKKQHPDKSFKDACAEGFYTYVVENGVRRKVKVRHVRCLAITAQPLKKHLFQPKDGDKEQYYYVSPGEAYGVFEYISKNGERLYESDNLFTLSEKMKNGTLTETPCPKCITDKKGKEYVHTRTVLKDAIILIFPSSERAEDQYQLDAATVSKRLYRINTIEMQRKRLTLTRHNLVKSWTGTNTICDSDFKDLPDGMRMSITKLHFLLLGKDFDIIDGKIVPLKKE

SEQ ID NO: 9031 - protein, 1425 aa, unidentified
  REGION 1..1425: note = Description of Unknown:uncultivated organism sequence
MTKILAFDPGTNSLGMVCRDTMNDNLMEQITSGVDIIRDNTERDKRGRHSSAASQRRSFRNARTRYRSVKRRKQATLKLLIKHNCCPLDMESLNKWRFDDDEKGYDRTFPVHNEEFMKWINFKFIIDGEEVKSVYRLREILVTKPLDFSRPESWLMLGRAIYSIAVRRGFKSSRLANSEINDEEDEEGVDLQKSEEELFSGLKQYMKEHNCKTVGAAFARMERVDKIRIRANNDYKPIRSKLKEEIEEIFKVQKRDTNSELYKGLMSEKKHEGTIFYKNPLKSQKGKVEYCTLEPRRRRCPKSHPANEFNTAWQLLNNIKIKRNGLWENITLDIRHKIFNELFVSNEKHFDFVKIREMLQNEYQIQLEYKESINYSDNKSIHGCPIIYYLQKILGPSWETERISGTNKHLKHAQRRKKLFNKEDKRSIEEYPETEGHLTEYTYEDIWHICYESDEKQFVKDFAKNVLCLSPSKVISMGALWEDIQDGYAKLSLCALKKINPFLAKGYKYSEAVMLANLPTIMGDTFFQQNEQEIIGLMDKERAAILSKNRIYDITNKLISDYKSLKLEGFAFAERADHDYILQDDDIEDVKKACAENFGKEWDALTDNQQSAIITHVKELYQKFFFSKERDYCKRINLADAVKAALAEKYPFLTKKKLKKLYHHSDNSYYPAAHTNENGILQLGNPARGNLKNPTVLKVLYKIKENVNKLLISGDIDADTIIVIENAREGLNDFNMRWAIEEYGKKREKENKAIEDALTDLATEFQLTLPKGCVSVARLALYQNRDFTPYNPNEPRRLYDKLCENYKLWLRQGFFDFYTGHPITLAQLFSPDNLVEVDHILPVSKSFDDSISNKVLSSTRYNRTIKGTKLPCELPNYNIDTAEGTPIIHRIQDIERKVKYLENKVIYWKSRSSRATNPESKNWAIKQCHLWQMEYDEWNQLLTNLTTREITPSFRHNQLNDTRIISKYAYHYLKSVFGRVVVQRGETTAVFRKIFGFQEVYEKKDRSRHTHHAIDALTLSMIPYGPRRERMMELWYQIQESHRFENYDTERQLKDKLDREVSLCGLGNYSPTEIVKYIEKTTLVRNDATNNALTKNIKRFRVRGKVVPLRDKYGNVIYEKTSKGIKRVKAKYVSQGNSIRGAIHDQSFYGKIEKWKNGKNHEIEEVFVIRKKIEFKSGDKGKGFKSWDDLKAQMVDKKLFDKFEEKEKDFKKACDEGIHICIAENGERRMVRVRRVRCIAKKAQPLKKHIFQPRKDNKERFYYVSSHGEAYGIFEYKSDEGKILYESDSLFTLSTKMKNGEMKEIPCPQHIIRTGKRFIHTRTIRKGDSILIYPEEEKPEDQYKLNTAILSNRLYRVDSIELDKRINLVRHFRGSMPKGKAIKKDADYNNLPEAIRPTLSDKLHFLLFGTDFDILNGKIVPLKND

SEQ ID NO: 9032 - protein, 1410 aa, unidentified
  REGION 1..1410: note = Description of Unknown:uncultivated organism sequence
MSKILAFDPGTNSLGMVLRDTDNGNLADQVTSGVDIFRDKTERDKRGRHHSAASQRRSFRNARTRLRSVKRRKQATLKLLIKHGCCPLDMEALNKWRFDDDEKGYDRTFPVSNESFMNWINFEFQIGNEKVRSVYRLREILATTPLDYSKPESWLMLGRALYSIAVRRGFKSSRLDSTKSDDTENDDTQQLQKSEEELSKGLSAYMTEHNCPTVGAAFARMERVDRIRIRANEDFKPIRAMLKKEIETIFDVQRLDTDSDLYKGLMSVKKHEGTIFYKNPLKSQKGKIEYCTLEPHRRRCPKSHPANEFNVAWQLLNNIKIKPEGVWEFLDIQVRHTLYQELFVRNVKHFDFKEIREKLEDIYNLTLEYRESINYSDTKSVNGCPISHYLQKIFGPDWQSVEIPGTKKHLTHADRRKGLKLDEAGHQTKYTAEDIWHICYESDEKEFVKDYADKLGLSSRYMGALWENIQDGYSKLSLCALRKINPFLERGYKYSDAVMLANLPTIMGKETFEQHEQEILHLIEEEKTRIAATNRDYDITNKLISEYKSLQLEGLAFAEKDYDYTLKEDDITAVKDACEENYGREWDTMPDGDKDALVTRIAHLYQDFFFSKKRDYYKRINLSDSLKTVLMEQFPFLTKSKLSKLYHHSDNAYYAPAKCDDDGIPQLGSPAKASLANPSVLKVLYKLKQNVNKMLKSGDIDTDTIVVVENAREELNDFNMRWAIEEYNNKREREHKYIEKALNELSAELGFTIPKESVQMARLALYQNENFTPYNPNEPHKFYDKQFDRYKSLLRQGFNDFYTDRPISLTEMFSENNLVEVDHILPISKSFDDSISNKVLSSSRYNSGVKGTRLPCELPNYQVDTPEGTAIIHRIDDIREKVKYLENKVDYWKGRSSRAADPDAKNSAIKQMHLWQMEYDEWNKRLINLTATEITPKFRSSQLNDTRIISKYAYHYLKTVFGRVVVQRGETTAVFRKIFGFQSAYEKKDRSRHTHHAIDALTLSLIPYGPKRERMMELFYEKQEAHRFKDYALEKQLQARLDSEIRFCGLGQYSPDEIVQHIEETTLVRNDATNNALTKNVKRYRVRGKVVPQRDADGNVIYEHTPKGKRVKAKHVSQGNSIRGAIHDQTFYGKISKWKDDGSHEKEEQFVIRRKIEYKSGDIGSGFTKWEDLRDHMVDKKLFEQLKKNAEGKDFPTACAEGLFVYVVENGEKREVRVRHVRCKAQTAQPLKRHTFQPKDKHAEQYYYVSPGEAYGIFEYKSNDGKYIYETDNLFSLSQKMKNGELKELPCPKRIIRKGKEYTHTRTILKEDTILVYPPNEQPEDQFKLTPAEISKRLYRINSIELPNRIKLTRHNLAESFKGRDTITDADFADLPDGFRKSVTTLKFLLLGTDFDIVNGKMVPISKTDE

SEQ ID NO: 9033 - protein, 1425 aa, unidentified
  REGION 1..1425: note = Description of Unknown:uncultivated organism sequence
MTKILAFDPGTNSLGMVCRDTMNDNLMEQITSGVDIIRDNTERDKRGRHSSAASQRRSFRNARTRYRSVKRRKQATLKLLIKHNCCPLDMESLNKWRFDDDEKGYDRTFPVHNEEFMKWINFKFIIDGEEVKSVYRLREILVTKPLDFSRPESWLMLGRAIYSIAVRRGFKSSRLANSEINDEEDEEGVDLQKSEEELFSGLKQYMKEHNCKTVGAAFARMERVDKIRIRANNDYKPIRSKLKEEIEEIFKVQKRDTNSELYKGLMSEKKHEGTIFYKNPLKSQKGKVEYCTLEPRRRRCPKSHPANEFNTAWQLLNNIKIKRNGLWENITLDIRHKIFNELFVSNEKHFDFVKIREMLQNEYQIQLEYKESINYSDNKSIHGCPIIYYLQKILGPSWETERISGTNKHLKHAQRRKKLFNKEDKRSIEEYTETEGHLTEYTYEDIWHICYESDEKQFVKDFAKNVLCLSPSKVISMGALWEDIQDGYAKLSLCALKKINPFLAKGYKYSEAVMLANLPTIMGDTFFQQNEQEIIGLMDKERAAILSKNRIYDITNKLISDYKSLKLEGFAFAERADHDYILQDDDIEDVKKACAENFGKEWDALTDNQQSAIITHVKELYQKFFFSKERDYCKRINLADAVKAALAEKYPFLTKKKLKKLYHHSDNSYYPAAHTNENGILQLGNPARGNLKNPTVLKVLYKIKENVNKLLISGDIDADTIIVIENAREGLNDFNMRWAIEEYGKKREKENKAIEDALTDLATEFQLTLPKGCVSVARLALYQNRDFTPYNPNEPRRLYDKLCENYKLWLRQGFFDFYTGHPITLAQLFSPDNLVEVDHILPVSKSFDDSISNKVLSSTRYNRTIKGTKLPCELPNYNIDTAEGTPIIHRIQDIERKVKYLENKVIYWKSRSSRATNPESKNWAIKQCHLWQMEYDEWNQLLTNLTTREITPSFRHNQLNDTRIISKYAYHYLKSVFGRVVVQRGETTAVFRKIFGFQEVYEKKDRSRHTHHAIDALTLSMIPYGPRRERMMELWYQIQESHRFENYDTERQLKDKLDREVSLCGLGNYSPTEIVKYIEKTTLVRNDATNNALTKNIKRFRVRGKVVPLRDKYGNVIYEKTSKGIKRVKAKYVSQGNSIRGAIHDQSFYGKIEKWKNGKNHEIEEVFVIRKKIEFKSGDKGKGFKSWDDLKAQMVDKKLFDKFEEKEKDFKKACDEGIHICIAENGERRMVRVRRVRCIAKKAQPLKKHIFQPRKDNKERFYYVSSHGEAYGIFEYKSDEGKILYESDSLFTLSTKMKNGEMKEIPCPQHIIRTGKRFIHTRTIRKGDSILIYPEEEKPEDQYKLNTAILSNRLYRVDSIELDKRINLVRHFRGSMPKGKAIKKDADYNNLPEAIRPTLSDKLHFLLFGTDFDILNGKIVPLKND

SEQ ID NO: 9034 - protein, 1410 aa, unidentified
  REGION 1..1410: note = Description of Unknown:uncultivated organism sequence
MSKILAFDPGTNSLGMVLRDTDNGNLADQVTSGVDIFRDKTERDKRGRHHSAASQRRSFRNARTRLRSVKRRKQATLKLLIKHGCCPLDMDSLNKWRFDDDEKGYDRTFPVSNESFMNWINFEFQIGNEKVRSVYRLREILATTPLDYSKPESWLMLGRAIYSIAVRRGFKSSRLDSTKSDDTENDDTQQLQKSEEELSKGLSAYMTEHNCPTVGAAFARMERVDRIRIRANEDFKPIRAMLKKEIETIFDVQRLDTDSDLYKGLMSEKKHEGTIFYKNPLKSQKGKIEYCTLEPHRRRCPKSHPANEFNVAWQLLNNIKIKREGVWEFLDIQVRHTLYQELFVRNVKHFDFKEIREKLEDIYNLTLEYRESINYSDTKSVNGCPISHYLQKIFGPDWQSVEIPGTKKHLTHADRRKGLKLDEAGHQTKYTAEDIWHICYESDEKEFVKDYADKLGLSSRYMGALWENIQDGYSNLSLCALRKINPFLERGYKYSDAVMLANLPTIMGKEAFEQHEQEILHLIEDERARIAAINRDYDIANKLISEYKSLQLEGLAFAERDYDYTLKEDDIAAVKAACAENYGREWDTMPDGDKDVLITHIAHLYQDFFFSKKRDYYKRFNLSDSLKSVMMEQFPFLTKGKLNKLYHHSDNAYYAPAKYGDDGIPQLGSPAKASLANPNVLKVLYKMKQNVNKMLKNRDIDTDTIVVVENAREALNDFNMRWAIEEYNNKREREHKYIEKALNELSAELGFSIPKESVEIARLALYHNENFTPYNPNESHKFYDKLFERYKLWLRQGFIDFYTGRPISLTELFSENNLVEVDHILPISKSFDDSISNKVLSSSRYNSGVKGTKLPCQLPNYQVDTPEGTAIIHRIDDIREKVKYLENKVDYWKGRSSRAADPDAKNSAIKQMHLWQMEYDEWNKRLINLTATEITPKFRSSQLNDTRIISKYAYHYLKTVFGRVVVQRGETTAVFRKIFGFQSAYEKKDRSRHTHHAIDALTLSLIPYGPKRERMMELFYEKQEAHRFKDYALEKQLQARLDSEIRFCGLGQYSPDEIIKHIEETTLVRNDATNNALTKNVKRYRVRGKVVPQRDADGNVIYEYTPKGKRVKAKHVSQGDSIRGAIHEQTFYGKIEKWKDNNISKKEELFVLRRKIEYKSGDNGSGFKSWEDLRDHMVDQKLFEQLKKNAEGKDFQKACAEGLFVYVVENGEKRKVCVRHVRCKAQTAQPLKRHTFQPKDKHAEQYYYVSPGEAYGIFEYKSSDGKFIYETDNLFSLSMKMKNGELKELPCPKHIIRKGKEYTHTRTILKEDTILVYPPKEQQEDQFKLTPAEISKRLYRINSIELPNRIKLTRHNLAESFKGRDTITDDDFNNLPDGFRKSVTTLKFLLLGKDFDIINGKMVPISKTDE

SEQ ID NO: 9035 - protein, 1413 aa, unidentified
  REGION 1..1413: note = Description of Unknown:uncultivated organism sequence
MSKILAFDPGTNSLGMVLRDTDNGNLADQVTSGVDIFRDKTERDKRGRHHSAASQRRSFRNARTRLRSVKRRKQATLKLLINHGCCPLDMESLNKWRFDDDEKGYDRTFPVGNEAFMNWINFEFQIGSEKVRSVYRLREILATTPLDYSKPESWLMLGRAIYSIAVRRGFKSSRLDSTSADDTENDDAQQLQKSEEELSKGLAAYMTEHNCPTVGAAFARMERVDRIRIRANEAFKPIRAMLKKEIETIFAVQQLDTDSDLYKGLMSEKKHEGTIFYKNPLKSQKGKIEYCTLEPHRRRCPKSHPANEFNVAWQLLNNIKIKRDGFWEFLDIQVRQTLYQELFVRNVKHFDFKEIRVKLEDIYNLTLEYRESINYSDTKSVNGCPITHYLQKILGPDWQNEKIPGTKKHLTHADRRKGLKLDEAGHTTTYTAEDIWHICFESDEKQFVKDFAKKELNLPPAKVNSMGALWENIQDGYSNLSLCALRKINPFLERGYKYSDAVMLANLPTIMGKEAFEQHEQEILHLIEDEKTRIAATNRDYDIANKLISEYKSLQLEGLAFAERDYDYTLKEDDIAAVKAACAENYGREWDTMPDGDKDVLITHIAHLYQDFFFSKKRDYYKRINLSDSLKSVMMEQFPFLTKGKLNKLYHHSDNAYYAPAKCGDDGIPQLGSPAKASLANPSVLKVLYKIKQNVNKMLKSGDIDTDTIVVVENAREELNDFNMRWAIEEYNNKREREHKYIEKALNELSAELGFTIPKESVQKARLALYQNENFTPYNPNEPHKFYDKLFEKYKLWLRQGFIDFYTGRPISLTELFSENNLVEVDHILPISKSFDDSISNKVLSSSRYNSGVKGTKLPCELPNYRVDTPEGTAIIHRIDDIREKVKYLENKVDYWKGRSSRAADPDAKNSAIKQMHLWQMEYDEWNKRLINLTATEITPKFRSSQLNDTRIISKYAYHYLKTVFGRVVVQRGETTAVFRKIFGFQSAYEKKDRSRHTHHAIDALTLSLIPYGPKRERMMELFYEKQEAHRFKDYALEKQLQARLDSEIRFCGLGQYSPDEIIKHIEETTLVRNDATNNALTKNVKRYRVRGKVVPQRDANGNVIYEHTPKGKRVKAKHVSQGDSIRGAIHDQTFYGKISKWKDNDGSHEKEEQFVLRRKIEYKSGDIGSGFKSWDDLKKQIVDQKLFEHLKKNAEGKDFQTACAEGLFVYVAENGEKKKVRVRHVRCKAQTAQPLKRHTFQPKDRHVEQYYYVSPGEAYGIFEYKSSDGKFIYETDNLFSLSMKMKNGELKELPCPKHIIRKGKEYTHTRTILKEDTILVYPPKEQPEDQFKLTPAEISKRLYRINSIELPNRIKMTRHNLAESFKGRDTITDDDFNNLPDGFRKSLTTLNFLLLGKDFDIINGRMVQKTDE

SEQ ID NO: 9036 - protein, 1424 aa, unidentified
  REGION 1..1424: note = Description of Unknown:uncultivated organism sequence
MTKILAFDPGTNSLGMVCRDTMNDNLMDQITSGVDIIRDNTETDRRGRHSSAASQRRTFRTARTRYRSVKRRKQATLKLLIKHSCCPLDVESLNKWRFDDDCKGYDRTFPVHNEAFMKWINFEFVIDGETVRSVYRLREILATKPLDFTKPESWLMLGRAIYSIAVRRGFKSSRLANASDADDEELPELQASEAELSKGLNQYMLDHNCPTVGAAFSRMERVDKIRIRANNDYKPIRKQLKEEIEVIFKVQQLDTDSELYKGLVSEKKHEGTIFYKNPLKSQKGKVEYCTLEPRKRKCAKSHPANEFNVAWQLLNNIKIKRDGLWENISLDIRKAIFDKLFVRNKKHFDFVEIRELLQDEYGIQLEYKENINYSDKKSVPGCPVTYYLQKILGPSWETEKIQGNKKHLKQAQRRKKQFDKDDNRNLKEYTEAEGHLTEYTYEDIWHICYESDEKQFVKDFAKDVLGLTPAKVISMGALWENIQDGYANLSLCALKKINPFLAKGYKYSDAVMLANLPTIMGGAFFKQNEQDIVNLIDEEKTAISDANRIYDIANKLISNYKALKMEGYAFAEHNCDYTLQEDDINDVKKACAENYGKVWETMTDVQQSEVITRVADLYQEFFFSSKRDYYKRINLSEALKNALAEKFPSLTKNKLKKLYHHSDNAYYPSAQANEDGILQLGSPARGNLRNPTVLKVLYKIKQNVNKLLLSGDIDSDTIIVVENAREALNDFNMRWAIEEYNSKRERENKAIEDALNDLAKEFHLTLPKECVPMARLALYQNANFTPYNPNESRRLYDKLCEKYKLWLKQGFFDFYTGRPISLSELFSPDNLVEVDHILPISKSFDDSISNKVLSSSRYNSSIKGTKLPCELPNYSVDTAEGTAIIHRIDEIKEKVKYLEDKVFYWKGRSSRAADPDSKNSAIKQMHLWQMEYDEWNQRLTNLTAKEITPSFRNNQLNDTRTISKYAYHYLKSVFGRVVVQRGETTAVFRKMFGFQDAYEKKDRSRHTHHAIDALTLSLIPYGPKREKMMELWYQIQEAHRFKDYVQERQLKDRLEREKALCGLGRYSPDEVVRYIEETTLVRNDATNHALTKNIKRYRVRGKVVPLRDESGNIVYEKAAKGIKRVKAKYVSQGNSIRGAIHDQSFYGKIEKWKDDGSHEMEELFVIRRKIEFKAGSVGSGFKSWDDLEKQMVDKKLFKKFKKQHPDKSFKDACAEGFYTYVVENGVRRKVKVRHVRCLAITAQPLKKHLFQPKDGDKEQYYYVSPGEAYGVFEYISKDGERLYESDNLFTLSEKMKNGTLTETPCPKCITDKKGKEYVHTRTVLKDAIILIFPSSERAEDQYQLDAATVSKRLYRINTIEMQRKRLTLTRHNLVKSWTGKNTIDDTDFMNLPDGMRMSIKNLNFLLLGKDFDIIDGKIVPLKNN

SEQ ID NO: 9037 - protein, 1176 aa, unidentified
  REGION 1..1176: note = Description of Unknown:uncultivated organism sequence
MGLTKGRGYDILYIVTLYHTKIQKVTEIRDFSRKALSPRKFSTGISFWREERTEGETGMSGEIKYEGGKRMKYRIGLDIGVASVGGCAMECDENGEPVRILDLCVRTFDAAEGEKGAPPAQPRREARGLRRRLRRRAHRLERVRALCAEAFGEDVLGRAEQNGEDLFRLRCAGLDEKLRDEELVRVLVHLAGHRGFRSNRKSESKDKETGELLKAIAENGEYMQAHGYRTVGEMFYRDPKYFEERAGRRVYTTRNRDGEYSRAFSRADIEKEARAILSRQEACGLVDGAFSEKYIEILLSQRSFDEGPAAPSPYRTEGYDVGDCPFEKGEKRASKAGFTAEYLAALQKINHLKIFLPSGEERFLSAAEREKLYAAAREKKEMNFAQVKKSLGLPEETSFNLVNYSARANVSPSDTEKKTKLFRMERSYELRAALDEKNRKNIPLLDEAANVLSLYKSDDRRMKAFSESGICAALSEEEKSRLLGLDFSGFVRLSYKAMNKLLPRLEEGLKYNEACEAAGYDFRAHDAPGDGKLSRLRGEEVRGYIEDIGVPVVRRALAQSVKVLNALLDKYGQPCGVNIELARELSKNSEERGRIARDNQKREEEFRAALEKLRTEFHLTAPKGTDVLKYRLYEEQGGKCAYSQKAIDSARLFESNYVQIDHVLPYSRSFDDGYNNKVLVLSAENQHKKDRTPFEYFGADEGRWGAFEAFVQTTYKNNRKKRENLLRRNFSEESAKDWKDRSLNDTRYICRAMYKLIADYLRMDPVAGKKKQVRAVNGRITAYLRNFWGLKKIRGAGDKHHAQDAAVIACVTDGTIARVTKYNKLKEKRAVWDQDAHKYLYADSDGVLLDADEYDSRSGLIKEPYRGFTDELRLRLSEAPKAYLPAKLLFLDGLGYTDQEIDGLSPVFVSRMPCRKAKGQIHEETIRSCRSKEEGVVSAKTPLVRLKLDKDGEIAGYNRRARQDDRLLYEALRARLQAFGGNGEKAFAEPFYKPTSDGKPGAVVKKVWTDTVFNTGVTLDRGAADNGGMVRIDVFEKEGKYYCVPVYIKDIYAKHLPDRAILAHKRYEDWTKIDDSFRFLFALFRNDLIYVKAKKPFNLSPNDKEEKQSVSVSEGFFYYRGINISTGAALIITHDNSYSTELGLKTLLKIEKYAVDILGNKYPVKREKRLNTEWDS

SEQ ID NO: 9038 - protein, 1164 aa, unidentified
  REGION 1..1164: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWTTIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTNRKAKGCINDATVYSSKYADNKNPTVCDGKNIIVIRTQINDKEKVKLDKDGEIIGYFQPEGDAALYNALKQRLNEYGGDAEKAFTQKNPIRKPCKNGQGNIVRSVKMYKTYTGDGMLLKKNKGIVKNDKGGGMIRVDLYSKGGKYYGVPVYVADLYRGELPKRAATQRKSQNEWRVMNDTYTFEMSIYKDDLLRIESEDGIEMKKKKDVENSAKAPTKIITDDLVYFIGFDRSTVSIEIEDTTGCYFARGVGIQKKIDKITRCEIDVLGNVQEIKKKPKQPLPLKMLTDKERVEKRKNNQNK

SEQ ID NO: 9039 - protein, 1123 aa, unidentified
  REGION 1..1123: note = Description of Unknown:uncultivated organism sequence
MDNDDMIRIGLDIGITSVGWAVMACDENGEPKRIVDLGSRIFDAAEKPKDGGSLAADRRDARGMRRRLRRKCERLRRLRALLEQYGYSVNFSGEDANILRIKGLNERLSENDLARVLYLLCKNRGFKSNKRQNKPTNDESSAKLQKDDEDGKLLKSADANEQLMISKNYRTVGEMLYAEYVLKGGKWHNIGGDYSHTVYRKNIRAELETLFEVQRTFGNPLADEEFEAKYFEIFEAQRSFDMGPGKGSKYSAEYKVGDCPFEEGEKRCPKASFSFEWSRALEKLNNVKIVGEYESRALSDEERKRAVEKMRSLETFSYNQLRRELRLSEEERFNLAYPRADFKALDKKIEERRVKGEIVDKEAERYKFERESRDKFEKKELVCSLRNSNSIRDALEGEHKKDDTLVDGVAELLSYSKSEEKRRAAFASGGYAEILSESEISSLIEIDCDKFGMLSLKALKKIIPHLEMGLKYSDAIQAAGYSLERTGMKREKLLGTEAVQAALDDINVPVVKRAVSQTVKVVNAIIRKYGSPLAISVELARELSHSKKERDKIDKNNKDRSSENERIKECIRSEFHIEPKPIDIVKYRLYEEQCCKCVYSGEPIDPNRLFGDNFYQIDHVMPFSRSFNDSYQNKVLVLTRENQNKGDRLPFEYMSEQQFAEFEARVRTFYAGNPKKREILLKKKLDENEWKSSALNDTGYISRTVSGLLGEHLLFDTRALGKKRVFTYSGGMTAYVRKHWGIEKIRSDGDLHHAVDAAMLACMTDAMSQRIALYNQYKETHFGKHVVDGESFDPVTGESFETMLRLPLPYANFRKELIARTEEDAGTMKNSLAALGYIEEQIAEARPATVSRMPMRGMKGKIHKETLRSAKYIDEGLVVSKTPIEKLKLDKNGEIDGYFKPESDLPLYELLKSMLQAADGKGEAAFKDKAVFKPRKDGTQGPRVYKVKTFVKSTSGVLLKKNGAIADNDNMCRVDVFTKDGKFYLVPVYVSDVYAGRLPMKAATNGKTEEEWRDVSAGFDFLFSLHKNDMIYVENKNGMNLSKMIKEDKSKLPEKKTLNACFGYFNSMDRANVAIKFEDINGCYECRVGALNLKKFVKYEVDVLGEAHPVGCEKRQPLHRPRS

SEQ ID NO: 9040 - protein, 1125 aa, unidentified
  REGION 1..1125: note = Description of Unknown:uncultivated organism sequence
MEKNEMIRIGLDIGIKSVGWAVVACDENGEPKSIVALGSRIFDAAEKPKDGGSLAADRRDARGMRRRLRRKSERLRRLRALFEEFGIAPNFSGEDANMLRVKGLDERLSENDFARVLYLLCKNRGFKSNKRDDKSSIDEKTSKTQKDDEEGKLLGFANANEELLTSKNYRTVGEMIYFEYVLKGGQWRNLRGDYSHTVYRKNSRAEIETLFEIQRGFGNALAKAEFEARYFVIFDSQRTFDMGPGKGSKYSAEYKVGDCPLEIGEKRCPKASFSFEWSRALEKLNNIKIVGAYESRALTQEERARVMARMRELETFNFFQLRRELHMTEEERFNLSYPRANFKALDKKLEERRAKGENVDEEEERYKFERAEREKFEKRELICSLKNSNDIRRALEGEHAEDDALVDSLAELLSYSKSEAKRRASFESGGYNDILSASEIDALLRLDFDKFGMLSLKALSNIIPHLEQGLKHSDAVEAAGYSLEGTGQARSKLLSTEAVQSLLEDINAPVVKRAVSQTVKVVNAIIRKYGSPLAISVELARDLSHSKKKRDEMDRENKTRHAENERIKDIIRAEFHIEPKPIDIVKYRLYEEQCGKCVYSGEPIDPNRLFSDNFYQIDHVMPFSRSFNDSYQNKVLVLTRENQNKGNRLPFEYLSEQQFVEFEARVRAFYAGNARKREILLKKKLDETEWKASALNDTSYISRAVRGLLADRLLFDERALGKKRVFTFSGRMTAYVRKHWGIEKIRSDGDLHHAVDAAVLACMTDGMSQRIAKYNKYRETHFGGRVVDGECFDPVTGESFETMLRLPLPYDSFRKELIARTEEDEATMKSSLAALGFDEDTIALTAPATVSRMPMRGMKGKIHKDTLRSAKYIDEGLIVSKTPLEKLKLDSNGEIENYFRPESDPALYELLKRMLKEAGGSGEKAFKDKPVYKPRKDGKQGPRVYGVKTYVRSTSGVLLVKSGAIADNDNMCRVDVYTRGGKFYVVPVYVSDVYAGKLPMKAATSGKPEEEWRDVSDPNEYEFLFSLHKNDMIYVESKNGMNLSKMIKDDNSKLPEKKTVYGCFGYFNSMDRSTAGIKFEDVNGCYQCRVGTLNLKRFEKYEVDVLGDVHLVGREKRQPLNKPRS

SEQ ID NO: 9041 - protein, 1123 aa, unidentified
  REGION 1..1123: note = Description of Unknown:uncultivated organism sequence
MDNDDMIRIGLDIGITSVGWAVMACDENGEPKRIVDLGSRIFDAAEKPKDGGSLAADRRDARGMRRRLRRKCERLRRLRALLEQYGYSVNFSGEDANILRIKGLNERLSENDLARVLYLLCKNRGFKSNKRQNKPTNDESSAKLQKDDEDGKLLKSADANEQLMISKNYRTVGEMLYAEYVLKGGKWHNIGGDYSHTVYRKNIRAELETLFEVQRTFGNPLADEEFEAKYFEIFEAQRSFDMGPGKGSKYSAEYKVGDCPFEEGEKRCPKASFSFEWSRALEKLNNVKIVGEYESRALSDEERKRAVEKMRSLETFSYNQLRRELRLSEEERFNLAYPRADFKALDKKIEERRVKGEIVDKEAERYKFERESRDKFEKKELVCSLRNSNSIRDALEGEHKKDDTLVDGVAELLSYSKSEEKRRAAFASGGYAEILSESEISSLIEIDCDKFGMLSLKALKKIIPHLEMGLKYSDAIQAAGYSLERTGMKREKLLGTEAVQAALDDINVPVVKRAVSQTVKVVNAIIRKYGSPLAISVELARELSHSKKERDKIDKNNKDRSSENERIKECIRSEFHIEPKPIDIVKYRLYEEQCCKCVYSGEPIDPNRLFGDNFYQIDHVMPFSRSFNDSYQNKVLVLTRENQNKGDRLPFEYMSEQQFAEFEARVRTFYAGNPKKREILLKKKLDENEWKSSALNDTGYISRTVSGLLGEHLLFDTRALGKKRVFTYSGGMTAYVRKHWGIEKIRSDGDLHHAVDAAMLACMTDAMSQRIALYNQYKETHFGKHVVDGESFDPVTGESFETMLRLPLPYANIRKELISRTEEDAGTMKNSLAALGYIEEQIAEARPATVSRMPMRGMKGKIHKETLRSAKYIDEGLVVSKTPIEKLKLDKNGEIDGYFKPESDLPLYELLKSMLQAADGKGEAAFKDKAVFKPRKDGTQGPRVYKVKTFVKSTSGVLLKKNGAIADNDNMCRVDVFTKDGKFYLVPVYVSDVYAGRLPMKAATNGKTEEEWRDVSAGFDFLFSLHKNDMIYVENKNGMNLSKMIKEDKSKLPEKKTLNACFGYFNSMDRANVAIKFEDINGCYECRVGALNLKKFVKYEVDVLGEAHPVGCEKRQPLHRPRS

SEQ ID NO: 9042 - protein, 1123 aa, unidentified
  REGION 1..1123: note = Description of Unknown:uncultivated organism sequence
MDNDDMIRIGLDIGITSVGWAVMACDENGEPKRIVDLGSRIFDAAEKPKDGGSLAADRRDARGMRRRLRRKCERLRRLRALLEQYGYSVNFSGEDANILRIKGLNERLSENDLARVLYLLCKNRGFKSNKRQNKPTNDESSAKLQKDDEDGKLLKSADANEQLMISKNYRTVGEMLYAEYVLKGGKWHNIGGDYSHTVYRKNIRAELETLFEVQRTFGNPLADEEFEAKYFEIFEAQRSFDMGPGKGSKYSAEYKVGDCPFEEGEKRCPKASFSFEWSRALEKLNNVKIVGEYESRALSDEERKRAVEKMRSLETFSYNQLRRELRLSEEERFNLAYPRADFKALDKKIEERRVKGEIVDKEAERYKFERESRDKFEKKELVCSLRNSNSIRDALEGEHKKDDTLVDGVAELLSYSKSEEKRRAAFASGGYAEILSESEISSLIEIDCDKFGMLSLKALKKIIPHLEMGLKYSDAIQAAGYSLERTGMKREKLLGTEAVQAALDDINVPVVKRAVSQTVKVVNAIIRKYGSPLAISVELARELSHSKKERDKIDKNNKDRSSENERIKECIRSEFHIEPKPIDIVKYRLYEEQCCKCVYSGEPIDPNRLFGDNFYQIDHVMPFSRSFNDSYQNKVLVLTRENQNKGDRLPFEYMSEQQFAEFEARVRTFYAGNPKKREILLKKKLDENEWKSSALNDTGYISRTVSGLLGEHLLFDTRALGKKRVFTYSGGMTAYVRKHWGIEKIRSDGDLHHAVDAAMLACMTDAMSQRIALYNQYKETHFGKHVVDGESFDPVTGESFETMLRLPLPYANFRKELIARTEEDAGTMKNSLAALGYLEEQIAEARPATVSRMPMRGMKGKIHKETLRSAKYIDEGLVVSKTPIEKLKLDKNGEIDGYFKPESDLPLYELLKSMLQAADGKGEAAFKDKAVFKPRKDGTQGPRVYKVKTFVKSTSGVLLKKNGAIADNDNMCRVDVFTKDGKFYLVPVYVSDVYAGRLPMKAATNGKTEEEWRDVSAGFDFLFSLHKNDMIYVENKNGMNLSKMIKEDKSKLPEKKTLNACFGYFNSMDRANVAIKFEDINGCYECRVGALNLKKFVKYEVDVLGEAHPVGCEKRQPLHRPRS

SEQ ID NO: 9043 - protein, 826 aa, unidentified
  REGION 1..826: note = Description of Unknown:uncultivated organism sequence
MLQKEIKYKSVKNILNLPETTKFNGLNYSNKENNKKNPENVRFVSMPLSQKISNALGEDVINKGNKCLYDKLAEILSYYKSDQKRDEQYNLYDATKSLTEEQRKKLNSLKISGFGNLSLVAIDKIIPYLEQGQLYDVACSNAGFDFRNIDRFKTDKSKKIKIEGEVYEYLKDISNPVVRRAIGQVIKVVNAIIDKYGSPQLLFIELARDIKKTIKERSDIQKRQNARMQNNENLKNDLIKFNIEPASKNLMIYKLYQEQDGKSVYSGKPILESCGVTNCDIRYLFNDKFVEIDHIIPYSKSFDDSWENKVLVLAKENQDKGERTPIEWLSGDKTMLDNYLDFVSATYSYNQKKMDHLLSNGAGKIEEWRSSSINDTRTITVYVKDLFERYLLFANSKYKRTVFCVNGRITNYLGKVWGITKNRSADDKHHARDACLIAVAESSMLQEITKYFQWKYYYENNNVQKTDTQDGGCYIIKDTGEKLTADEYDKYITKYVIEPYPNFRKELFARLCNSPQNPEKDCNFALTDCYLQYSDEQIKSIRPIFVSQMANHKATGKLFDDTIYGNSGKVDKNGKRICTKKVSLTKLALTSDKQEIKDYYNQAKIDDPATYNAVLKRLQEFNGDAVKAFGDPNNPLYKPTKDGKTGNVIKKVKLQMVADNCSSLKDRGIAKVDGMLRIDIFSKSNAGKKRYYAVPVYLIDVYKSQIPTKVCATGKAASKWDDISNGYAFEFSLYSGDLFRLKFADKLIPGILQKDGKTKILSQDEYFYYNGFDRSTNSISFKTHDDSMEFRSIGFQSAMIFEKYNVDLLGNISKVTSKKREMINKK

SEQ ID NO: 9044 - protein, 1136 aa, unidentified
  REGION 1..1136: note = Description of Unknown:uncultivated organism sequence
MSKFYRIGLDIGIGSVGYAVIENDPVTEEPCRIMKLGVRTFSPNEVDKTGESTAKNRRENRGIRRRKRRKAFRFERTRNLISKTFGKQIFDELNLLCLGDKEKGISPADVYRLRAKALDEKLSDAELCRVILHLLKRRGFKSNRKSQSSNKDDGLLLKATGENRKRMEDNGYRTIGEMLYLDPKFKREVAGKTFYDIRNHGGDYSNCFFREDLSNELDLILKTQRELGNEKVTEEFESKILEIFNSQRNFDEGPGKESPYKANFEVGNCTFIPTEKRAPKASYTFELFNALSKINNLKVNDTVLSDEQRNAIYNKIKEQKELKFEDIRKMFKFSGSEIFNLCSYKLKKEDNDLPQDEYIQKCENKVFISMKNSYEIKKKLKLESSYESRDIIDEVANILSYSKSDSKIDNAIANSEILKNLTDEQKQAIKEMNFDKFGSLSYKAMKMIEPFLLQGQRYDVACQSTGFNHSSFEHEKMKYLKGKEIDERLADITNNVVKRSVNQTLRIVNQIIKTYGSPEFISIELARELGKNHQDRDKINKQIKERTEANDDFANKLTEKFHIVKPTGQDILKYKLYEEQCGKCMYSGHPIDETRLFEPNYVQIDHILPISKSLNDSYNNKVLVIADQNQNKGDKTPYEFFGSDEERWNNFVARVMLLKNREKQRNLLKKTITEDDSKEFISRNLNDTRYMSKLLLGIFEDYLQMAPVKQNGKAKRKVVYSVNGAITSYLRKCWRLAKIRDDGDIHHAVDASLIAMVDDSITQKITRFNKFKETFAFSDGKFINKTTGEVMTKDEMLEYKTEQVQEFGKTLAEPYPNFVNELKIRSTVKYDSFEFSNEEKQELLKLGYSDEEMESAKPVFVSRMKTVKKTGAIHQETMMSTREYEETGNLIKTVPISSLKLKSKIESVKLKDDKYPEFSIENYYRPEDDRLLYLKLKEILHDNPDGLKKGNVHKPRKDGSDGPLVRSVKQYYKASKPVITKNGGALNGSMFRVDVFEKDKKFYLCPVYMSDVYAHKLPNKVIEIGKDWTTIDKSFNFKFSLYQNDLVKITSKKDIVLKKTFDNPKSKKPDSINGKEMLVYYNSTGIAVASIKIQSHDNCYKQESLGVKTLLNMEKYYVDIMGNVYKAPENEKREKI

SEQ ID NO: 9045 - protein, 1176 aa, unidentified
  REGION 1..1176: note = Description of Unknown:uncultivated organism sequence
MGLTKGRGYDILYIVTLYHTKIQKVTEIRDFSRKALSPRKFSTGISFWREEKAEGETGMSGEIKYEGGKRMKYRIGLDIGVASVGGCAMECDENGEPVRILDLCVRTFDAAEGEKGAPPAQPRREARGLRRRLRRRAHRLERVRALCAEAFGEDVLGRAEQNGEDLFRLRCAGLDEKLRDEELVRVLVHLAGHRGFRSNRKSESKDKETGELLKAIAENGEYMQAHGYRTVGEMFYRDPKYFEERAGRRVYTTRNRDGEYSRAFSRADIEKEARAILSRQEACGLVDGAFSEKYIEILLSQRSFDEGPAAPSPYRTEGYDVGDCPFEKGEKRASKAGFTAEYLAALQKINHLKIFLPSGEERFLSAAEREKLYAAAREKKEMNFAQVKKSLGLPEETSFNLVNYSARANVSPSDTEKKTKLFRMERSYELRAALDEKNRKNIPLLDEAANVLSLYKSDDRRMKAFSESGICAALSEEEKSRLLGLDFSGFVRLSYKAMNKLLPRLEEGLKYNEACEAAGYDFRAHDAPGDGKLSRLRGEEVRGYIEDIGVPVVRRALAQSVKVLNALLDKYGQPCGVNIELARELSKNSEERGRIARDNQKREEEFRAALEKLRTEFHLTAPKGTDVLKYRLYEEQGGKCAYSQKAIDSARLFESNYVQIDHVLPYSRSFDDGYNNKVLVLSAENQHKKDRTPFEYFGADEGRWGAFEAFVQTTYKNNRKKRENLLRRNFSEESAKDWKDRSLNDTRYICRAMYNLIADYLRMDPVAGKKKQVRAVNGRITAYLRNFWGLKKIRGAGDKHHAQDAAVIACVTDGTIARVTKYNKLKEKRAVWDQDAHKYLYADSDGVLLDADEYDSRSGLIKEPYRGFTDELRLRLSEAPKAYLPAKLLFLDGLGYTDQEIDGLSPVFVSRMPCRKAKGQIHEETIRSCRSKEEGVVSAKTPLVRLKLDKDGEIAGYNRRARQDDRLLYEALRARLQAFGGNGEKAFAEPFYKPTSDGKPGAVVKKVWTDTVFNTGVTLDRGAADNGGMVRIDVFEKEGKYYCVPVYIKDIYAKHLPDRAISAGKRFDDWVKIDDSFRFLFALFRNDLIYVKAKKPFNLSPNDKEEKQSVSVSEGFFYYRGIDCATGAALLIVHDNSYSTRLGFKTLLKIEKYAVDILGNKYPVKREKRLNTEWDS

SEQ ID NO: 9046 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEKTIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLQRENQNKRNSTPVEYFERIGRDYDEVLAFWKAVYQKRNRKKLEFLQKKEINELEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9047 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINQLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9048 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDSVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 9049 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPEMEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9050 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVLVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9051 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLEGIRKLFIENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKQGKKKNEGEAKSDVVEINDVVDSLACEDKGEFIAAKNSNKILKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKFLGTKEVYDAIGGVTSLVVKRALSQTVKVIDAVIRQYGSPYAINIELARDMSMTKDERDKLKKENDARAAKNEAIRENIAKLNAMPNSTNVLKYKLYEEQDHKCAYSMETLDITHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMLLEKNKGIVKNDGMIRVDLYSKDGKYFGVPVYVADLYRGELPKRAATNGKPQNEWRVIDDTYTFEMSIYQDDLLRIESKKGIELKKNKDVENSAKATTKTITDDFAYFIGFNRSTASIKIEDTTGCYFAKSIGIQNIGKITKCEIDVLGNVQEIKKRPKQPQPLKMLTDKEKAEKRKNNQNK

SEQ ID NO: 9052 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRGVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9053 - protein, 1142 aa, unidentified
  REGION 1..1142: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDENKEKYLNIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKSDKKKNEGESKSDVVEINDVVDSLACEDKGEFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKFLGTKEIYDAIGGVTSPVVKRALSQTVKVIDAVIRQYGSPYAINIELARDMSMTKDERDKLKKENDARAAKNEAIREIIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARAMDEPVLMQNKLRLLGFNENYLMNAKPFVVSRMTSRKAKGCINEATVFSSKYADNKYPTVCEGNNVIVKRTALANLKLDKNGEINGYFQPEGDAALYNALKQRLVEFDGDAKKAFATPIRKPCNSGQGNIVRTVKTYETYTGGGMILEKNKGIVKNDGMIRVDLYSKDGKYFGVPVYVADLYRGELPKKAATKRKTKNEWREMDDTYTFEMSIYKDDLLRIESEDGIELKKKKDVENSAKAPTKTIMDDFVYFIGFDTDSPRITIEDTTGCYCGRKGIQSIKKITKCEIDVLGNVQEIKKRPKQPQPLKMLTDKERAEKRKNNQNK

SEQ ID NO: 9054 - protein, 1155 aa, unidentified
  REGION 1..1155: note = Description of Unknown:uncultivated organism sequence
MYRLGLDVGIKSVGWCVLECDENGEPIQIDALNSRIFDAAEQPKTGASLAEPRRNARGLRRRIRRKSFRLERIRKLFIENGIELFETHEDLICLKDEYKNLDVVKLRADALDKKLTEAEFARVLYSLARHRGFKSNKRVVETDDGDEEKKRKGKDSDEGKLLSSIRDSEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRNAIAESKIIDGRLDEETIEKLSKIDMKGYGHLSLHVLREILPYLEEGMVYSDAMQKAGHNHSEHNFEKQKFLGTKEVYDAIGGVTSHVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIEIYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFATPIRKPCNSGQGNIVRTVKTYETYTGGGMLLEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 9055 - protein, 1157 aa, unidentified
  REGION 1..1157: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFIENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKQGKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFAPTNPIRKPCNSGQGNIVRTVKTYETYTGGGMILEKNKGIVKNDGMIRVDLYSKDGKYFGVPVYVADLYRGELPKKAATHSKPQNEWRVIDDTYTFEMSIYQDDLLRIENKKGIELKKNKDVENSAKAASKTIVDDFVYYIGFDRSTVSIKVEDTTGCYFARGVGIQNIGKITKCEIDVLGNVQEIKKRPKQPQPLKMLTDKERAEKRKNNQNK

SEQ ID NO: 9056 - protein, 1157 aa, unidentified
  REGION 1..1157: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLLEFGGDAKKAFAPTNPIRKPCNSGQGNIVRTVKTYETYTGGGMLLEKNKGIVKNDGMIRVDLYSKDGKYFGVPVYVADLYRGELPKRAATANKPQNEWREMDDTYTFEMSIYQDDLLRIESKKGIELKKKKDVENSAKATSKTITDDFVYFIGFNRSTASIEVEDTTGCYRRDGIGTQNIGKITKCEIDVLGNVQEIKKRPKQPQPLKMLTDKEKAEKRKNNQNK

SEQ ID NO: 9057 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9058 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINSLSIICGGDRRRLSNEERQIAVELAKKVDKVSYKAFRKAIKLDDDYRFSALNYSEKKKQGKKKNEGESKSDVVEINDVVDSLACEDKGEFITAKNSNKILKALNDNLKSDVELIDEIAEICTKYKSENLFRNAIAESKIIGGRLDEETIEKLSKIDMKGYGHLSLHVLREILPYLEEGMVYSDAMQRAGHNHSEHNFEKQKFLGTKEVYDAIGGVTSPVVKRALSQTVKVIDAVIRQYGSPYAINIELARDMSMTKDERDKLKKENDARAAKNEAIREIIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARAMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFSGDAKKAFAPTNPMRKPCKNGQGNIVRTVKTYETYTGGGMILEKNKGIVKNDGMIRVDLYSKDGKYFGVPVYVADLYRGELPKKAATHSKPQNEWRVIDDTYTFEMSIHQDDLLRIENKKGIELKKNKDVENSAKAATKTITDDFVYYIGFDRSTVSIKVEDTTGCYFARGVGIQNIGKITKCEIDVLGNVQEIKKRPKQPQPLKKLTDKERAEKRKNKQNK

SEQ ID NO: 9059 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSTLNYSEKKKQGKKKNEGESKSDVVEINDVVDSLACEDKGEFITAKNSNKIVKALNDNLKSDIELVDEIAEICTKYKSENLFRNAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFDRIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMDAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 9060 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKVVGECTFEKGEKRACKASYISERFVLLEKINHLRICTADGNERPLNEDEKSAVIKLAYKTKVVKYNAIRKELKLDLEERFGGLTYSKVNNGDFKQRILNTEKKSDFISLKYWHEVKDILNLSYKDLTEEQKQLMDSVGKVLTYYKSEEKRREELSDLSLNQAQIEKLQKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVVDLIRRHLVVEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9061 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKKEGESKSDVVEINDVVDSLACEDKGDFITAKNSNKIVKALNDNLKSDIELIDEIAEICTKYKSENLFRSAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9062 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVAKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCISEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATNGKQQNEWRVIDDTYTFEMSIYQDDLLRIESKKGIELKKNKDVENSAKATTKTITDDFAYFIGFDRSTASIKIEDTTGCYFAKSIGIQNIGKITKCEIDVLGNVQEIKKRPKQPQPLKMLNDKEKAEKRKNNQNK

SEQ ID NO: 9063 - protein, 1134 aa, unidentified
  REGION 1..1134: note = Description of Unknown:uncultivated organism sequence
MKYRIGLDIGIASVGGCAMECDENGEPVRILDLSVRIFDKAEDPQTGASLALPCRTARGMRRRLRRRAHRLERVRRLCLEQFGNDVLQRAEGNKEDIFRLRFAGLSETLRDEELTRVLIYFAKHRGFRSNRKSEGKDKDTGKMLKAVRENETYMREKGYATVGEMLYRDPKYFEIVEGRKIYHTRNGDGDYGKAFAREDIRREAEAILARQAEGGLVDRAFAEKYLGIFSSQRSFDEGPASPSPYRLEGYDIGNCIFLPTEKRAPKASYTFEYGTALQKINNLKVIDGGTERFLTAEEREKLYAAAREKKEYDFLQVKKLLSLPSSASFNLVTYSSAKAGKKGKKGETEKAVKTPEETEKKTKLFKMDKSYAIRACLSEDKRKNIPLLDEIARILSLYKSDERRLAAFAASEECAALTEEEKSALLEEECSKFGSISVKAMTEIIRSLEKGKKYSEACVEAGYDFRAHGRSSEEKYPRLRGKEVREFIEEINVPVVRRAVAQSVKVLNAYLDKYGAPCGVNIELARELAKNFDERNKILRENKSREENYQSELEKLQNEFHLKMPKGTDVWKLRLYEEQRGKCPYSGKTIDSTRLFESNYVQIDHILPYSRSFDDSYNNKVLVLSEENQNKKNRTPFEYFGADAARWSNFEAFVKSTYDGNRKKRDNLLRQSFTEDNEKEWKERALNDTKYISRVVYNLVNDYLLLDPIEGKKKQVCTVNGRITAYLRKFWGLQKDRSAGDKHHAQDAAVIACVTDGVIQKVTKFNKIKELLKIRKGSTIKGFSAQWDEVSRRHVFIDADGVVLTEDEYDERNGYHKQPYEGFVKELQFRLMENPQAFIQPHLSLLQSLGYSDEEIDGIRPVFVSRMPSRKAKGAIHKETIRSARSLAEGVTSSKTPLTQLKLTKDKTAIEAYNEKAKRDDRLLYDALLTRLQAADGKAEKAFAEPFYKPTKDGRQGPLVRKVWIDSAFNAGVVLENGKSVADNGGMVRIDVFRKDGKYFCVPVYTKDIYAKRLPDRAITAGKKYADWDKIDGTFEFLFALFANDLIYVKARNSFKLKALDKEEKQQVSMSEGFFYYKGIDIATGAALLITHDHSYETRLGLKTLLRLEKYTVDVLGEKYPVRKEKRLNTEWDT

SEQ ID NO: 9064 - protein, 1164 aa, unidentified
  REGION 1..1164: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETQDDLICLKDEYKNLDVVKLRSDALDKKLTEAEFARVLYSLARHRGFKSNKRVVETDDGDEEKKGKGKNKDEGKLLSSIRESEEEMRESGMRTRGEQLYKKYLMEGKPVHNKGGDYSMCVSRDILVKEIELLFEKQKKFGNSFVTDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGEFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTNRKAKGCINDATVYSSKYADNKNPTVCEGKNIIVIRTQINDKEKVKLDKDGEIIGYFQPEGDAALYNALKQRLNEYGGDAEKAFTQKNPIRKPCKNGQGNIVRSVKMYKTYTGDGMLLKKNKGIVKNDKGGGMIRVDLYSKGGKYYGVPVYVADLYRGELPKRAATQRKSQNEWRVMNDTYTFEMSIYKDDLLRIESEDGIEMKKKKDVENSAKAPTKIITDDLVYFIGFDRSTVSIEIEDTTGCYFARGVGIQKKIDKITRCEIDVLGNVQEIKKKPKQPQPLKMLTDKERVEKRKNNQNK

SEQ ID NO: 9065 - protein, 1163 aa, unidentified
  REGION 1..1163: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFIENGIELFETQDDLICLKDEYKNLDVVKLRSDALDKKLTEAEFARVLYSLARHRGFKSNKRVVVTDDDDEEKKGKGKDGDEGKLLSSIRESEEEMRESGMRTRGEQLYKKYLMEGKPVHNKYGDYSMCVSRDILVKEIELLFEKQKEFGNNFATDKNKEKYLNIFLSQRNFDEGPGKGSQYTGSHDVKKCEIYRDEEVAAKGTYTSEWATIYQRINNLSIICGGDRRRLSNEERQIAVELAKKVEKVTYKAFRKAIKLDDDYRFSALNYSEKKKRNKKKNEGESESDVVEINDVVDSLACEDKGEFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPTATNVLKYKLYEEQDHKCAYSMETLDINHLFEDGYYEIDHIIPYSRSFDDSFNNKVLVLKRENQNKRNSTPVEYFERIGRDYDDVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTNRKAKGCINEATVYSSKYADNKYPTVCGGKNIIVKRTQINDKEKFKLDKDGEIIGYFQPEGDAALYNALKQRLNEYGGDAEKAFTQKNPIRKPCKNGQGNIVRSVKMYKTYTGDGMLLKKNKGIVKNDKGGGMIRVDLYSKDGKYFGVPVYVADLYRGELPKKAATHSKPQNEWRVIDDTYTFEMSIYQDDLLRIENKKGIELKKNKDVENSAKASTKIITDDFAYFISFDRSTASIKIEDTTGCYFAKSIGIQNIGKITKCEIDVLGNVQEIKKRPKQPQPLKMLTDKERAEKRKNKQNK

SEQ ID NO: 9066 - protein, 1082 aa, unidentified
  REGION 1..1082: note = Description of Unknown:uncultivated organism sequence
MRKKIRYVIGLDIGIASVGWAALLLDENDNVCGIVRAGVHTFDEAVVGQSKITGAAYRRGYRSGRRSIRRKVNRIQRVKNLLQRLNIISKKDLEEYFSGAVENIYYLRCAAIQNEPAYILNNKELAQLLIYYAKHRGYKSNTSYEQKTDDSKKVLSALSENKKYMLEKGYQTAGEMLYRDEKFRRKRYGSSEECELLLVRNSGDDYSHSISRELLVEEVHVIFARQRELGNKLTTKELEDQFVEIMQSQRNYDEGSGEGSPYGGNLIEKMVGECTFEKGEKRACKASYTSERFVLLEKLNHLRIQSKNGDVRALTEEERDAIIKLAYKNKDVKYKALRTILKLNPDERFGGLTYSRGDIENSTEGKSVFVSLEYWYEIKKVLGLFYDDLDNEETQQLLDSIGTILTCYKSDDLRRRKFEQLHLEQEKIEHLLALNYTKFQNLSFKAMKNIMPELEKGLSYTEACSNAGYGDKETIEGKNKYISKELLNNTLDSIMNPTVKRAVRRTIRILNELIKQYGSPVEVHVEMARDLTHSQTVTNKMKKRQDENKAEKEEAKRFICENFGKTEAQVSGKDILRYRLWKSQNQIDIYSNTMIPVSDILDYEKYEVDHIIPYSCSFNDSFNNKMLVRKKDNQDKKNRTPYEYIGSDEKKWEAFATCANTYVMNYGKRKNMLTKVPASNTGEWMSRNLNDTRYTTKVVTDLIRKHLKFEAYVDQKRKKHIYPINGGITAKLRYEWGLEKDREKSDKHHAQDAVVIACCTDGMIQRLSRQYMLQEIGIVTWKNHKLVDRRTGEIVEETNLPWECFREEVEMFMADSPEDYIEKAKKNGYKGEAPKPIFVSRLPQKKTTGKINEDTLRSVRIDSKGKARFVNKTKLQDLKLVEVDGKKQIKDYYRPEDDKLLYDKLLERLVKNDDAKVVFAEPFYKPKKDGSDGPIVRSVKTYGKTVKNQVLVGDGVAERGGIYRCDVFKRKDEYYAVVVYYRDLYIGNLPNNAAHFDIEMKKGEFEFSLYKDDLIRFVKDGKEQYAYYKYINANNSQITYTEHDTSKETKCTTIRTLDKFQKMNVDLLGNIYSSDKEEREWN

SEQ ID NO: 9067 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFTENGIELFETQDDLICLKDEYKNLDVVKLRSDALDKKLTEAEFARVLYSLARHRGFKSNKRVVETDDGDEEKKRKGKDSDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKQGKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSLVVKRALSQTVKEIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFDRIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMLLEKNKGIVKNDGMIRVDLYSKDGKYFGVPVYVADLYRGELPKRAATNGKSQNEWRVIDDTYTFEMSIYQDDLLRIENKKGIELKKNKDVENSAKAASKTIVDDFVYYIGFDRSTVSIKVEDTTGCYFARGVGIQNIGKITKCEIDVLGNVQEIKKRPKQPQPLKMLTDKERAEKRKNNQNK

SEQ ID NO: 9068 - protein, 1149 aa, unidentified
  REGION 1..1149: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKSDKKKNEGESKSDVVEINDVVDSLACEDSEFITAKNSNKIVKALNDNLKSDIELIDEIAEICTKYKSENLFRSAIAESKIIGGRLDEETIEKLSKIDMKGYGHLSLHVLREILPYLEEGMVYSDAMQTAGHNHSEHNFEKQKFLGTKEVYDAIGGVTSLVVKRALSQTVKVIDAVIRQYGSPYAINIELARDMSKTKKERDIIKQENDARAAKNEAIRENIAKLNAKPTATNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTNRKAKGCINDATIYSSKYADNKNPTVCGGKNIIVIRTQINDKEKVKLDKDGEIIGYFQPEGDAALYNALKQRLNEYGGDAEKAFTQKNPIRKPCKNGQGNIVRSVKMYKTYTGDGMLLKKNKGIVKNDKGGGMIRVDLYSKGGKYYGVPVYVADLYRGELPKKAATKRKSKDEWRVMDDTYTFEMSIYKDDLLRIESEDGIELKKNKDVENSAKAPTKTIMDDFVYFIGFDTDSPRITIEDTTGCYCGRKGIQSIKKITKCEIDVLGNVQEIKKRPKQPQPLKMLTDKERAEKRKNNQNK

SEQ ID NO: 9069 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKKKYLDIFLSQRNFDEGPGKGSQYTGSHDVKKCEIYRDEDVAAKGTYTSEWATIYQKINNLSIICGGDRRRLSNEERQIAVELAKKVEKVSYKAFRKAIKLDDDYRFSALNYSEKKKSDKKKNEGESKSDVVEINDVVDSLACEDKGEFITAKNSNKIVKALNDNLKSDIELIDEIAEICTKYKSENLFRNAIAESKIIDGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNTLKQRLVEFDGDAKKAFAPTNPIRKPCNSGQGNIVRTVKTYETYTGGGMILEKNKGIVKNDGMIRVDLYSKDGKYFGVPVYVADLYRGELPKRAATAGKPQNEWRVIDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 9070 - protein, 1152 aa, unidentified
  REGION 1..1152: note = Description of Unknown:uncultivated organism sequence
MYRLGLDVGIKSVGWCVLECDENGEPIQINALNSRIFDAAEQPNTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDENKEKYLDIFLSQRNFDEGPGKGSQYTGSHYVKKCEIYRDEDVAAKGTYTSEWATIYQKINNLSIICGGDRRRLSNEERQIAVELAKKVEKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRKAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINDATVYSSKYADNKNPTVCGGKNIIVKRTQINDKEKFKLDKDGEIIGYFQPEGDAALYNALKQRLLEYGGDAEKAFTQKNPIRKPCNNGQGNIVRSVKMYKTYTGDGMLLKNNKGIVRNDKGGGMIRVDLYSKDGKYFGVPVYVADLYRGELPKRAATQRKSQNEWRVMNDTYTFEMSIYKDDLLRIESEDGIELKKKKDVENSAKTPTKIITNDLVYFIGFDRSTVSIEIEDTTGCYFARGVGIQKKIDKITKCEIDVLGNVQEIKKRPKQPQPLKMLTDKEKAEKRKNNQNK

SEQ ID NO: 9071 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKQGKKKNEGESKSDVVEINDVVDSLACEDKGDFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMLLEKNKGIVKNDGMIRVDLYSKDGKYFGVPVYVADLYRGELPKRAATAGKPQNEWRVIDDTYTFEMSIYQDDLLHIESKKGIEFKKNKDVENSAKASTKIIMDDFAYFISFDRATATIKIEDTTGCYFARSIGIQNIGKITKCEIDVLGNVQEIKKRPKQPQPLKMLTDKERAEKRMKNQNK

SEQ ID NO: 9072 - protein, 1142 aa, unidentified
  REGION 1..1142: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEQMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKSDKKKNEGESKSDVVEINDVVDSLACEDSEFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLVDGEICDSDYYDKNSHLVLPYPYKEFINELDARVMDEPVLMQNKLRLLGFNENYLMNAKPFVVSRMTSRKAKGCINEATVFSSKYADNKYPTVCEGNNVIVKRTALANLKLDKNGEINGYFQPEGDAALYNALKQRLVEFDGDAKKAFATPIRKPCNSGQGNIVRSVKTYETYTGGGMILEKNKGIVKNDGMIRVDLYSKDGKYFGVPVYVADLYRGELPKKAATKRKSKDEWRVMDDTYTFEMSIYQDDLLRIENKKGIELKKNKDVENSAKAASKTIVDDFVYYIGFDRSTVSIKVEDTTGCYFARGVGIQNIGKITKCEIDVLGNVQEIKKRPKQPQPLKMLTDKERAEKRKNNQNK

SEQ ID NO: 9073 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLQRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIEIYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALSSLKLDKNGEIDGYFQPEGDAALYNALKHRLVEFDGDAKKAFATPIRKPCNSGQGNIVRTVKTYETYTGGGMLLEKNKGIVKNDGMIRVDLYSKDGKYFGVPVYVADLYRGELPKRAATNGKPQNEWRVIDDTYTFEMSIYQDDLLHIESKKGIEFKKNKDVENSAKASTKIITDDFAYFISFDRSTASIKIEDTTGCYFAKSIGIQNIGKITKCEIDVLGNVHEIKKRPKQPQPLKMLTDKERAEKRKKNQNK

SEQ ID NO: 9074 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEDRFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSLGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRGVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9075 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRHLSNEERQIAVELVKKVDKVSYKSFRKAIKLDDDYRFSALNYSEKKKSDKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFAPTNPIRKPCNSGQGNIVRTVKTYETYTGGGMLLEKNKGIVKNDGMIRVDLYSKDGKYFGVPVYVADLYRGELPKRAATANKPQNEWREMDDTYTFEMSIYQNDLLRIESKKGIELKKDRNNEFSAKENSILLNDGYVYFTSFCISTAAIKIEDTTGCYVAPSVGIQNLKKITKCEIDVLGNVQEIKKRPKQPQPLKMLTDKERAEKRKNNQNK

SEQ ID NO: 9076 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDENKEKYLDIFLSQRNFDEGPGKGSQYTGSHYVKKCEIYRDEDVAAKGTYTSEWATIYQKINNLSIICGGDRRRLSNEERQIAVELAKKVEKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRKAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFATPIRKPCNSGQGNIVRTVKTYETYTGGGMLLEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 9077 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETHEDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKSDKKKNEGESKSDVVEINDVVDSLACEDKGDFITAKNSNKIVKALKDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFATPIRKPCNSGQGNIVRTVKTYETYTGGGMLLEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 9078 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDGGPGEGSPYGGNLIEKMVGECTFEKGEKRACKASYISERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKLLKLNYAKFHNLSFKVMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDICRKDILRYRLWKNQSQMDLYSEKLIPVEDILDYEKYEVDHIIPYSRSFNDSFNNKMLVKKKDNQDKKNHTPHEYIGHDDEAWNKFVKMVNNYVLSPGKRKNALTKSSDSDEWRSRNLNDTRYTTKVVADLIRRHLVVEPYFNGARNKHVYPLNGGVTARLRHEWGLEKDREKSDKHHAQDAIVIACCTEKMIWKMSNIYKQEELGGVVRKGNKLVERRTGEILETTALPWKWFREEVEMVMADHPEDYIEMAKDRGYMGDIPKPIFVSRLPVKKKTGVISENTIRAVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9079 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETHEDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQRINNLSIICGGDRRRLSNEERQIAVELAKKVEKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINQLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGIQKIREDGDKHHAVDAAIIACVTPKTKNKIERYNQIKESRKMRNGQYVLEDGEICDSDYYDKNSHLVLPYPYKDFINELDARVMDEPVLMQNKLRLLGFNENYLMKAKPFVVSRMTSRKAKGCINEATVFSSKYADNKYPTVCDGNNVIVKRTALANLKLDKNGEINGYFQPEGDAALYNALKQRLVEFDGDAKKAFAPTNPIRKPCNSGQGNIVRTVKTYETYTGGGMILEKNKGIVKNDGMIRVDLYSKDGKYFGVPVYVADLYRGELPKRAATANKPQNEWREMDDTYTFEMSIYQDDLLHIESKKGIELKKKKDVENSAKALTKTITDDLVYFIGFNRSKASIEVEDTTGCYNMDGLGIQNVGKITKCEIDVLGNVQEIKKRPKQPQPLKMLTDKERAEKRKKNQNK

SEQ ID NO: 9080 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFCNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGEFITAKNSNKIVKALNDNLKSDIELIDEIAEICTKYKSENLFRSAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDITHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMLLEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 9081 - protein, 1157 aa, unidentified
  REGION 1..1157: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFTENGIELFETQDDLICLKDEYKNLDVVKLRSDALDKKLTEAEFARVLYSLARHRGFKSNKRVVVTDDDDEEKKGKRKENDEGELLSSIRKSEEEMRESGMRTRGEQLYKKYLMEGKPVHNKGGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRKRLSNEERQIAVELAKKVEKVTYKAFRKAIKLDDDYRFSALNYSEKKKSDKKKNEGESKSDVVEINDVVDSLACEDKGEFITAKNSNKIVKALNDNLKSDIELIDEIAEICTKYKSENLFRSAIAESKIIGGRLDEETIEKLSKIDMKGYGHLSLHVLREILPYLEEGMVYSDAMQKAGHNHSEHNFEKQKLLGTKEVYDAIRGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKQNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFAPTNPIRKPCKNGQGNIVRTVKTYETYTGGGMILEKNKGIVKNDGMIRVDLYSKDGKYFGVPVYVADLYRGELPRRAATQGKPQNEWREMDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 9082 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWTTIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9083 - protein, 1152 aa, unidentified
  REGION 1..1152: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQTEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVSYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGSVTSLVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLQRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKDKIERYNQIKESRKMRNGQYVLEDGEICDSDYYDKNSHLVLPYPYKEFINELDARVMDEPVLMQNKLRLLGFNENYLMNAKPFVVSRMTNRKAKGCINDATVYSSKYADNKNPTVCEGKNIIVIRTQINDKEKVKLDKDGEIIGYFQPEGDAALYNALKQRLNEYGGDAEKAFTQKNPIRKPCKNGQGNIVRSVKMYKTYTGDGMLLKKNKGIVKNDKGGGMIRVDLYSKDGKYFGVPVYVADLYRGELPKRAATQRKSQNEWRVIDDTYTFEMSVYKDDLLRIESEDGIEMKKKKDVENSAKAPTKIITDDLVYFIGFDRSTVSIEIEDTTGCYFARGVGIQKKIDKITRCEIDVLGNVQEIKKRPKQPQPLKMLTDKEKAEKRKNNQNK

SEQ ID NO: 9084 - protein, 1035 aa, unidentified
  REGION 1..1035: note = Description of Unknown:uncultivated organism sequence
MDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRRRLSNEERQIAVELAKKVEKVSYKAFRKAIKLDDDYRFSALNYSEKKKQGKKKNEGEAKSDVVEINDVVDSLACEDKGEFIAAKNSNKILKALNDNLKSDIELIDEIAEICTKYKSENLFRNAIAESKIIDGRLDEETIEKLSKIDMKGYGHLSLHVLREILPYLEEGMVYSDAMQKAGHNHSEHNFEKQKFLGTKEVYDAIGGVTSLVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKQNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTSKTKNKIERYNQIKESRKMRNGQYVLEDGEICDSDYYDKNSHLVLPYPYKDFINELDARVMDEPVLMQNKLRLLGFNENYLMKAKPFVVSRMTSRKAKGCINEATVFSSKYADNKYPTVCDGNNVIVKRTALANLKLDKNGEINGYFQPEGDAALYNALKQRLVEFDGDAKKAFAPTNPIRKPCNSGQGNIVRTVKTYETYTGGGMILEKNKGIVKNDGMIRVDLYSKDGKYFGVPVYVADLYRGELPKRAATANKPQNEWREMDDTYTFEMSIYQDDLLHIESKKGIELKKKKDVENSAKALTKTITDDLVYFIGFNRSKASIEVEDTTGCYNMDGLGIQNVGKITKCEIDVLGNVQEIKKRPKQPQPLKMLTDKERAEKRKKNQNK

SEQ ID NO: 9085 - protein, 1154 aa, unidentified
  REGION 1..1154: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLIGLKDEYKNLDVVKLRSDALDKKLTEAEFARVLYSLARHRGFKSNKRVVVTDDDDEEKKGKRKENDEGELLSSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSTLNYSEKKKQGKKKSEGESKSDVVEINDVVDSLACEDSEFIIAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDIKHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMILEKNKGIVKNDGMIRVDLYSKDGKYFGVPVYVADLYRGELPKKAATHSKPQNEWRVIDDTYTFEMSIHQDDLLRIESKKGIELKKKKDVENSAKALTKTITDDLVYYIGFNRSKASIEVEDTTGCYNMDGLGIQNIGKITKCEIDVLGNVQEIKKRPKQPQPLKMLTDKERAEKRKNNQNK

SEQ ID NO: 9086 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKILKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRVVDEASSRTVEKTSLDKLKLIEVNGKKQIKDYYRPEDDVLLYNKLLDKLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9087 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIGRRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIREIIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARAMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFAPTNPMRKPCKNGQGNIVRTVKTYETYTGGGMILEKNKGIVKNDGMIRVDLYSKDGKYFGVPVYVADLYRGELPKKAATHSKPQNEWRVIDDTYTFEMSIHQDDLLRIENKKGIELKKNKDVENSAKAATKTITDDFVYYIGFDRSTVSIKVEDTTGCYFARGVGIQNIGKITKCEIDVLGNVQEIKKRPKQPQPLKKLTDKERAEKRKNKQNK

SEQ ID NO: 9088 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFTENGIELYETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRRRLSNEERQIAVELAKKVEKVTYKTFRKAIKLDDDYRFSALNYSEKKKQGKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPRRAATANKPQNEWREMDDTYTFEMSIYQDDLLRIESKKGIELKKKKDVENSAKATSKTITDDFVYFIGFNRATGAMEIEDTSGCYYKDSVGIQNVGKITKCEIDVLGNVQEIKKRPKQPQPLKMLTDKERAEKRKNNQNK

SEQ ID NO: 9089 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRHLSNEERQIAVELVKKVDKVSYKSFRKAIKLDDDYRFSALNYSEKKKSDKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTIKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLLEFGGDAKKAFAPTNPIRKPCNSGQGNIVRTVKTYETYTGGGMLLEKNKGIVKNDGMIRVDLYSKDGKYFGVPVYVADLYRGELPKRAATANKPQNEWREMDDTYTFEMSIYQNDLLRIESKKGIELKKDRNNEFSAKENSILLNDGYVYFTSFCISTAAIKIEDTTGCYVAPSVGIQNLKKITKCEIDVLGNVQEIKKRPKQPQPLKMLTDKEKAEKRKNNQNK

SEQ ID NO: 9090 - protein, 1159 aa, unidentified
  REGION 1..1159: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFIENGIELFETQDDLICLKDEYKNLDVVKLRSDALDKKLTEAEFARVLYSLARHRGFKSNKRVVVTDDDDEEKKGKGKDGDEGKLLSSIRESEEEMRESGMRTRGEQLYKKYLMEGKPVHNKYGDYSMCVSRDILVKEIELLFEKQKEFGNNFATDKNKEKYLNIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKQGKKKNEGESESDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGWINSATIYSTKYADNKNPTVCGGKNIIVKRIQINDKKNFKLDKNGEISGYFQPEGDVALYNALKQRLIEFGGDAEKAFAKPIRKPCKNGQGNIVRTVKTYETYTGGELLLKNVKGIVKTDNIMRLDLYSKDGKYFGVPVYVADLYRGELPKRAATQKKSQNEWRVMDDTYTFEMSIYQDDLLRIESKKGIELKKKKDVENSAKALTKTITDELVYFIGFDRSTASIEIEDTTGCYFARGVGIQKKIDKITKCEIDVLGNVQEIKKRPKQPQPLKILTDKERAEKRKNKQNK

SEQ ID NO: 9091 - protein, 1153 aa, unidentified
  REGION 1..1153: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKVFRKAIKLDDDYRFSTLNYSEKKKQGKKKSEGESKSDVVEINDVVDSLTCEDSEFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSLVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIEIYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATANKPQNEWREMDDTYTFEMSIYQDDLLRIESEDGIELKKNKDVENSVKAPTKTITNDLVYYLGFDRDGARIKIEDTTGCYCGRKGIQGIKKITKCEIDVLGNVQEIKKRSKQPQPLKMLTDKERAEKRKKNQNK

SEQ ID NO: 9092 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDENKEKYLDIFLSQRNFDEGPGKGSQYTGSHYVKKCEIYRDEDVAAKGTYTSEWATIYQKINNLSIICGGDRRRLSNEERQIAVELAKKVEKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRKAIAESKIIGGRLDEETIEKLSKIDIKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFATPIRKPCNSGQGNIVRTVKTYETYTGGGMLLEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 9093 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRESEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVSYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRNAIAESKIIGGRLDEETIEKLSKIDMKGYGHLSLHVLREILPYLEEGMVYSDAMQKEGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFAPTNPIRKPCKNGQGNIVRTVKTYETYTGGGMILEKNKGIVKNDGMIRVDLYSKDGKYFGVPVYVADLYRGELPKRAATAGKPQNEWRVIDDTYTFEMSIYQDDLLHIESKKGIEFKKNKDVENSAKASTKIIMDDFAYFISFDRATATIKIEDTTGCYFARSIGIQNIGKITKCEIDVLGNVQEIKKRPKQPQPLKMLTDKERAEKRKNNQNK

SEQ ID NO: 9094 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIVLFEAQDDLICLKDEYKNLDVVKLRSDALDKKLTEAEFARVLYSLARHRGFKSNKRVVVTDDDDGEKKGKGKEKDEGKLLSSIRESEEKMRESGMRTRGEQLYKRYLMEGKPVHNKGGDYSMCVSRDILVKEIELLFEKQKEFGNTFATDKNKEKYLDIFLSQRNFDEGPGKGSQYTGSHDVKKCEIYRDEDVAAKGTYTSEWATIYQKINNISIICGGDRRRLSNEERQIAVELAKKADKVTYKAFRKAIKLDDDYRFSALNYSEKKKQGKKKNEGESKSDVVEINDVVDSLACEDKGEFITAKNSNKIIKALNDKLKSDIELIDEIAEICTKYKSENLFRSAIAKSKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAVKNEAIRENIAKLNAMPNATNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDQYGRVETVKGAITSYLRRFWGVPKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMKAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMLLEKNKGIVKNDGMIRVDLYSKDGKYFGVPVYVADLYRGELPKRAATNGKPQNEWRVIDDSYTFEMSIYQDDLLRIENKKGIEFKKNKDVENSAKAASKTITDDFVYFIGFDRSTVSIKVEDTTGCYFARGVGIQNIGKITKCEIDVLGNVQEIKKRPKQPQPLKMLTDKEKAEKRKTNQNK

SEQ ID NO: 9095 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETQDDLICLKDEYKNLDVVKLRSDALDKKLTEAEFARVLYSLARHRGFKSNKRVVVTDDDDEEKKGKRKENDEGELLSSIRKSEEEMRESGMRTRGEQLYKKYLMEGKPVHNKGGDYSMCVSRDILVKEIELLFEKQKEFGNNFATDVNKEKYLDIFRSQRNFDEGPGKGSQYTGSHDVKKCEIYRDEDVAAKGTYTSEWATIYQRINNLSIICGGDRRRLSNEERQIAVELAKKVDKVSYKAFRKAIKLDDDYRFSALNYSEKKKQGKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNPTNVLKYKLYEEQDHKCAYSMETLDINHLFEDGYYEVDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCEGNNVIVKRTALANLKLDKNGEINGYFQPEGDAALYNALKQRLVEFDGDAKKAFATPIRKPCNSGQGNIVRTVKTYETYTGGGMLLEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 9096 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENEIELFETQDDLICLKDEYKNLDVVELRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKSDKKKNEGESKSDVVEINDVVDSLACEDKGDFITAKNSNKILKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDTRAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLINAKPFVVSRMTSRKAKGCINEATVFSSKYADNKYPTVCDGNNVIVKRTALANLKLDKNGEINGYFQPEGDVALYNALKQRLVEFDGDAKKAFAPTNPIRKPCNSGQGNIVRTVKTYETYTGGGMILEKNKGIVKNDGMIRVDLYSKDGKYFGVPVYVADLYRGELPKRAATAGKPQNEWRIMDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9097 - protein, 1155 aa, unidentified
  REGION 1..1155: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFSENEIELFETQDDLICLKDEYKNLDVVKLRSDALDKKLTEAEFARVLYSLARHRGFKSNKRVVVTDDDDEEKKGKGKDGDEGKLLSSIRESEEEMRESGMRTRGEQLYKKYLMEGKPVHNKYGDYSMCVSRDILVKEIELLFEKQKEFGNNFATDKNKEKYLNIFLSQRNFDEGPGKGSQYTGSHDVKKCEIYRDEDVAAKGTYTSEWATIYQRINNLSIICGGDRRRLSNEERQIAVELAKKVEKVTYKAFRKAIKLDDDYRFSALNYSEKKKQGKKKNEGESKSDVVEINDVVDSLACEDKGDFITAKNSNKIVKALNDNLKSDIELINEIAEICTKYKSENLFRNAIAESKIIGGRLDEETLEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFGGDAKKAFATPIRKPCNSGQGNIVRTVKTYETYTGGGMILEKNKGIVKNDGMIRVDLYSKDGKYFGVPVYVADLYRGELPKKAATKRKSKNEWRVMDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKKNQNK

SEQ ID NO: 9098 - protein, 1165 aa, unidentified
  REGION 1..1165: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFSENEIELFETQDDLICLKDEYKNLDVVKLRSDALDKKLTEAEFARVLYSLARHRGFKSNKRVVVTDDDDEEKKGKGKGKDGDEGKLLSSIRESEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIGGRLDEETIEKLSKIDMKGYGHLSLHVLREILPYLEEGMVYSDAMQKAGHNHSEHNFEKQKYLGTKEVYDAIGGVTSHVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDDVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTNRKAKGCINEATVYSSKYADNKYPTVCGGKNIIVKRTQINDKEKFKLDKDGEIIGYFQPEGDAALYNALKQRLNEYGGDAEKAFTQKNPIRKPCKNGQGNIVRSVKMYKTYTGDGMLLKKNKGIVKNDKGGGMIRVDLYSKDGKYFGVPVYVADLYRGELPRRAATQGKPQNEWREMDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 9099 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFHSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMIMEKNKGIVKNDGMIRVDLYSKDGKYFGVPVYVADLYRGELPKRAATNGKQQNEWRVIDDTYTFEMSIYQDDLLRIESKKGIELKKNKDVENSAKATTKTITDDFAYFIGFDRSTASIKIEDTTGCYFAKSIGIQNIGKITKCEIDVLGNVQEIKKRPKQPQPLKMLNDKEKAEKRKNNQNK

SEQ ID NO: 9100 - protein, 1142 aa, unidentified
  REGION 1..1142: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDNDYRFSALNYSEKKKQGKKKNEGESKSDVVEINDVVDSLACEDSEFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMEEPILMQNKLRLLGFNENYLMNAKPFVVSRMTSRKAKGCINEATVFSSKYADNKYPTVCEGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPRRAATQGKPQNEWREMDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 9101 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRHLSNEERQIAVELVKKVDKVSYKSFRKAIKLDDDYRFSALNYSEKKKSDKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATANKPQNEWREMDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9102 - protein, 1157 aa, unidentified
  REGION 1..1157: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKRVVVTDDDDEEKKGKRKENDEGELLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKQGKKKNEGESESNVVEINDVVDSLACEDKGDFITAKNSNKIVKALNDNLKSDIELIDEIAEICTKYKSENLFRNAIAESKIIDGRLDEETIEKLSKIDMKGYGHLSLHVLREILPYLEEGMVYSDAMQKAGHNHSEHNFEKQKFLGTKEVYDAIGGVTSLVVKRALSQTVKVIDAVIRQYGSPYAINIELARDMSMTKDERDKLKKENDARAAKNEAIRENIAKLNAMPNSTNVLKYKLYEEQDHKCAYSMETLDITHLFEDGYYEIDHIIPYSRSFDDSFNNKVLVLKRENQNKRNSTPVEYFDRIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFAPTNPIRKPCNSGQGNIVRTVKTYETYTGGGMILEKNKGIVKNDGMIRVDLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 9103 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSTKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9104 - protein, 1155 aa, unidentified
  REGION 1..1155: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFSKNGIELFETQDDLICLKDEYKNLDVVKLRSDALDKKLTEAEFARVLYSLARHRGFKSNKRVVETDDGDEEKKRKGKDSDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVSYKAFRKAIKLDDDYRFSALNYSEKKKQGKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGIVYSDAMQKAGHNHSEHNFEKQKYLGTKEVYDAIGGVTSLVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFDRIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPMVCDGNNVIVKRTALANLKLDKNGEINGYFQPEGDAALYNALKQRLVEFDGDAKKAFATPIRKPCNSGQGNIVRTVKTYETYTGGGMLLEKNKGIVKNDGMIRVDLYSKDGKYFGVPVYVADLYRGELPKRAATNGKSQNEWRVIDDTYTFEMSIYQDDLLRIESKKGIELKKNKDVENSAKATTKTITDDFAYFIGFDRSTASIKIEDTTGCYFAKSIGIQNIGKITKCEIDVLGNVQEIKKRPKQPQPLKMLTDKERAEKRKNNQNK

SEQ ID NO: 9105 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFIENGIELFETQDDLICLKDEYKNLDVVKLRSDALDKKLTEAEFARVLYSLARHRGFKSNKRVVVTDDDDEEKKGKRKENDEGELLSSIRKSEEEMRESGMRTRGEQLYKKYLMEGKPVHNKGGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKQGKKKNEGESESDVVEINDVVDSLACEGKGEFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDIKHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFDGDAKKAFATPIRKPCNSGQGNIVRTVKTYETYTGGGMILEKNKGIVKNDGMIRVDLYSKDGKYFGVPVYVADLYRGELPKKAATHSKPQNEWRVIDDTYTFEMSIHQDDLLRIESKKGIELKKKKDVENSAKALTKTITDDLVYYIGFNRSKASIEVEDTTGCYNMDGLGIQNIGKITKCEIDVLGNVQEIKKRPKQPQPLKMLTDKERAEKRKNNQNK

SEQ ID NO: 9106 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNNRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHNVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLQRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9107 - protein, 1145 aa, unidentified
  REGION 1..1145: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQRINNLSIICGGDRRRLSNEERQIAVELAKKVEKVSYKAFRKAIKLDDDYRFSALNYSEKKKSDKKKNEGESKSDVVEINDVVDSLACEDKGEFITAKNSNKIVKALNDNLKSDVELIDEIAEICTKYKSENLFRSAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLQRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMKAKPFVVSRMTSRKAKGCINEATVFSSKYADNKYPTVCDGNNVIVKRTALANLKLDKNGEINGYFQPEGDVALYNALKQRLVEFGGDAKKAFAPTNPIRKPCNSGQGNIVRTVKTYETYTGGGMILEKNKGIVKNDGMIRVDLYSKDGKYFGVPVYVADLYRGELPKKAATHSKPQNEWRVIDDTYTFEMSIYQDDLLRIENKKGIELKKNKDVENSAKAASKTIIDDFVYYIGFDRSTVSIKVEDTTGCYFARGVGIQNIGKITKCEIDVLGNVQEIKKRPKQPQPLKMLTDKERAEKRKNNQNK

SEQ ID NO: 9108 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRHLSNEERQIAVELVKKVDKVSYKSFRKAIKLDDDYRFSALNYSEKKKSDKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9109 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLQRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9110 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRESIAKLNAKPTATNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATANKPQNEWREMDDTYTFEMSIYQNDLLRIESKKGIELKKDRNNEFSAKENSILLNDGYVYFTSFCISTAAIKIEDTTGCYVAPSVGIQNLKKITKCEIDVLGNVQEIKKRPKQPQPLKMLTDKERAEKRKNNQNK

SEQ ID NO: 9111 - protein, 1158 aa, unidentified
  REGION 1..1158: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFSENGIELFETQDDLICLKDEYKNLDVVKLRSDALDKKLTEAEFARVLYSLARHRGFKSNKRVVVTDDDDEEKKGKGKGKDSDEGKLLSSIRKSEEEMRESGMRTRGEQLYKKYFMEGKPVHNKCGDYSMCVSRDILVKEIELLFEKQKEFGNNFATDKNKEKYLDIFLSQRNFDEGPGKGSQYTGSHDVKKCEIYRDEDVAAKGTYTSEWATIYQKINNLSIICGGDRRRLSNEERQIAVELAKKAEKVTYKAFRKAIKLDDDYRFSALNYSEKKKRNKKKNEGESKSDVVEINDVVDSLACEDKGEFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTVKVIDAIIRQYGSPYAINIELARDMSMTKDERDKLKKENDARAAKNEAIRENIAKLNAKPTATNVLKYKLYEEQDHKCAYSMETLDINQLFEDGYYEIDHIIPYSRSFDDSFNNKVLVLQRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFAPTNPIRKPCNSGQGNIVRTVKTYETYTGGGMILEKNKGIVKNDGMIRVDLYSKDGKYFGVPVYVADLYRGELPKRAATQGKPQNEWRIMDDTYTFEMSIYQDDLLRIESEDGIELKKKKDVENSATAPTKTITNDLVYYLGFDRDGARIKIEDTTGCYCGRKGIQGIKKITKCEIDVLGNVQEIKKRPKQPQPLKMLTDKERAEKRKKNQNK

SEQ ID NO: 9112 - protein, 1155 aa, unidentified
  REGION 1..1155: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFSENGIELFETQDDLICLKDEYKNLDVVKLRSDALDKNLTEAEFARVLYSLARHRGFKSNKRVVEIDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKQGKKKNEGESKSDVVEINDVVDSLACEDKGDFITAKNSNKIVKALNDNLKSDIELIDEIAEICTKYKSENLFRNAIAESKIIGGRLDEETIEKLSKIDMKGYGHLSIHVLREILPYLEEGMVYSDAMQKAGHNHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFEGDAKKAFATPIRKPCNSGQGNIVRTVKTYETYTGGGMILEKNKGIVKNDGMIRVDLYSKDGKYFGVPVYVADLYRGELPKRAATANKPQNEWCEMDDTYTFEMSIYQDDLLHIESKKGIELKKKKDVENSAKALTKTITDDLVYFIGFNRSKASIEVEDTTGCYNMDGLGIQNIGKITKCEIDVLGNVQEIKKRPKQPQPLKMLTDKEKAEKRKNNQNK

SEQ ID NO: 9113 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNNRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEDRFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKIESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPGKRKNALTKSSDSDEWRSRNLNDTRYTTKVVADLIRRHLVFEPYFNGARNKHVYPLNGGVTARLRHEWGLEKDREKSDKHHAQDAIVIACCTEKMIWKMSNIYKQEELGGVVRKGNKLVDRRTGEILETTALPWKWFREEVEMVMADHPEDYIERAKDRGYMGDIPKPIFVSRLPVKKKTGVISENTIRGVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGAKDRGGMYRCDIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9114 - protein, 1144 aa, unidentified
  REGION 1..1144: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLSSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVEKVTYKAFRKAIKLDDDYRFSALNYSEKKKQGKKKNEGESKSDVVEINDVVDSLACEDKGDFITAKNSNKIVKALNDNLKSDIELIDEIAEICTKYKSENLFRNAIAESKIIGGRLDEETIEKLSKIDMKGYGHLSLHVLREILPYLEEGMVYSDAMQKAGHNHSEHNFEKQKFLGTKEVYDAIGGVTSHVVKRALSQTVKVIDAVIRQYGSPYAINIELARDMSMTKDERDKLKKENDARAAKNEAIRENIAKLNAMPNSTNVLKYKLYEEQDHKCAYSMETLDINQLFEDGYYEIDHIIPYSRSFDDSFNNKVLVLKRENQNKRNSTPVEYFERIGRDYDEVLAFWKAVYQKRNRKKLEFLQKKEVNESEWKNRALNDTRYASRMLANLIKDYLLFDEKSKDKYGRVETVKGAITSYLRRFWGVQKIREDGDKHHAVDAAIIACVTPKTKNKIEIYNQIKESRKMRNGQYVLEDGEICDSDYYDKNSHLVLPYPYKEFINELNARVMDEPVLMQNKLRLLGFNENYLMNAKPFVVSRMTSRKAKGCINEATVFSSKYADNKYPTVCDGNNVIVKRTALANLKLDKNGEINGYFQPEGDAALYNALKQRLVEFGGDAKKAFAPTNPIRKPCKNGQGNIVRTVKTYETYTGGGMILEKNKGIVKNDGMIRVDLYSKDGKYFGVPVYVADLYRGELPKRAATANKPQNEWREMDDTYTFEMSIYQDDLLRIESEDGIELKKNKDVENSVKAPTKTITNDLVYYLGFDRDGARIKIEDTTGCYCGRKGIQGIKKITKCEIDVLGNVQEIKKRSKQPQPLKMLTDKERAEKRKKNQNK

SEQ ID NO: 9115 - protein, 1163 aa, unidentified
  REGION 1..1163: note = Description of Unknown:uncultivated organism sequence
MYRLGLDVGIKSVGWCVLECDENGEPIQINALNSRIFDAAEHPQTGASLAEPRRNARGLRRRIRRKSFRLERIRKLFTENGIELFETQDDLICLKDEYKNLDVVKLRSDALDKKLTEAEFARVLYSLARHRGFKSNKRVVVTDDDDEEKKGKGKGKDRDEGKLLSSIRESEEEMRESGMRTRGEQLYKKYLMEGKPVHNKGGDYSMCVSRDILVKEIELLFEKQKEFGNTFATDENKEKYLDIFLSQRNFDEGPGKGSQYTGSHDVKKCEIYRDEDVAAKGTYTSEWATIYQKINNLSIICGGDRRRLSNEERQIAVELAKKAEKVTYKAFRKAIKLDDDYRFSTLNYSEKKKQGKKKSEGESKSDVVEINDVVDSLACEDSEFITAKNSNKIVKALNDNLKSDIELIDEIAEICTKYKSENLFRSAIAESKIIGGRLDEETIEKLSKIDMKGYGHLSLHVLREILPYLEEGMVYSDAMQKAGHNHSEHNFEKQKYLGTKEVYDAIGGVTSLVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTNRKAKGCINDATIYSSKYADNKNPTVCGGKNIIVIRTQINDKEKVKLDKDGEIIGYFQPEGDAALYNALKQRLNEYGGDAEKAFTQKNPIRKPCKNGQGNIVRSVKMYKTYTGDGMLLKKNKGIVKNDKGGGMIRVDLYSKGGKNYGVPVYVADLYRGELPKKAATKRKSKDEWRVMDDTYTFEMSIYKDDLLRIESEDGIELKKKKDVENSAKAPTKTIMDDFVYFIGFDTDSPRITIEDTTGCYCGRKGIQSIKKITKCEIDVLGNVQEIKKRPKQPQPLKMLTDKERAEKRKNNQNK

SEQ ID NO: 9116 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9117 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEKTIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMIMEKNKGIVKNDGMIRVDLYSKDGKYFGVPVYVADLYRGELPKRAATNGKQQNEWRVIDDTYTFEMSIYQDDLLRIESKKGIELKKNKDVENSAKATTKTITDDFAYFIGFDRSTASIKIEDTTGCYFAKSIGIQNIGKITKCEIDVLGNVQEIKKRPKQPQPLKMLNDKEKAEKRKNNQNK

SEQ ID NO: 9118 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKEKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSNEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9119 - protein, 1161 aa, unidentified
  REGION 1..1161: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKRVVETDDGDEEKKRKGKDSDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGEAKSDVVEINDVVDSLACEDKGDFITAKNSNKIVKALNDNLKSDVELIDEIAEICTKYKSENLFRSAIAESKIIGGRLDEETIEKLSKIDMKGYGHLSLHVLREILPYLEEGMVYSDAMQKAGHDHSEHNFEKQKYLGTKEVYDAIGGVTSPVVKRALSQTVKVIDAVIRQYGSPYAINIELARDMSMTKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFDRIGRDYDEVLAFWKAVYQKRNRKKLEFLQKKEINESEWKNRALNDTRYASRMLANLIKDYLLFDEKSKDKYGRVETVKGAITSYLRRFWGIQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMDAKPFVVSRMTNRKAKGCINEATVFSSKYADNKYPMVCGGKNIIVKRTQINDKKNFKLDKNGEISGYFQPEGDAALYNALKQRLLEFGGDAEKAFAPTNPIRKPCKNGQGNIVRAVKTYEAYTGGGMLLEKNKGIVKNDGMIRVDLYSKDGKYFGVPVYVADLYRGELPKKAATKRKSKNEWRVMDDTYTFEMSIYKDDLLRIESEDGIELKKKKDVENSAKAPTKTIADDFVYFIGFDRSTVSIEIEDTTGCYFARGVGIQKKIDKITRCEIDVLGNVQEIKKRPKQPQPLKILTDKERAEKRKNKQNK

SEQ ID NO: 9120 - protein, 1143 aa, unidentified
  REGION 1..1143: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKKLTEAEFARVLYSLARHRGFKSNKREGAKDSDEGKLLGSIRKSEEEMRESGMRTRGEQLYKKYLMEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRHLSNEERQIAVELVKKVDKVSYKSFRKAIKLDDDYRFSALNYSEKKKSDKKKNEGESKSDVVEINDVVDSLACEDKGDFITAKNSNKIVKALNDNLKSDVELIDEIAEICTKYKSENLFRNAIAESKIIGGRLDEETIEKLSKIDMKGYGHLSLHVLREILPYLEEGMVYSDAMQKAGHNHSEHNFEKQKYLGTKEVYDAIGGVTSPVVKRALSQTIKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMLLEKNKGIVKNDGMIRVDLYSKDGKYFGVPVYVADLYRGELPKRAATANKPQNEWREMDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9121 - protein, 1146 aa, unidentified
  REGION 1..1146: note = Description of Unknown:uncultivated organism sequence
MNYRIGLDIGISSIGWSVIEHDENDSPARIVDLGVRLFSPAEINNKGENKPLALDRRVARGTRRRVRRMKYRIRSMYNLLCKKFHFDKTYQELNALIESKNYNVYELRHKAINEKLDNLELTKILLYFVKHRGYLCTSTSEDNANEESSKMKAYLSKNDNDYQKSGKETYGEYLYQSRTKREYSKHGEKKIEFIYQTRNHNGEYKKCISRDLLAKEIEAILDCQQGFGNNLIDSNFKEDILDIFNKQINFDEGPNFPSPYKGLYKVGNCTLIPSEKRAPKGAFSFEYFRALQKINQLTIIDESGKHIISKEQKEILQKKLFSQKEIKYKSVKSILKLPKTTKFNGLNYSNKANSKKDTEDTLFVSMPTTQKISNALGEDAINKENKCLYNKLAEILSYYKSDEKRDKQYELYDETKDLGKVQKEKLNALKISKFGNLSLVALDKIIPYLEQGQLYNEACSSAGFDFKNIDRYSKGKSEKIKVDDGVGEYLKDITNPVVRRAIGQVIKVVNAIIDKYGSPQLLFIELARDIKKTIKERAYIQKKQNARMQNNENLKNDLIKLNIEPTSKNLMIYKLYQEQGGKSPYSGKPILESCGIANCDIKYLFNDKFVEVDHIRPYSKSFDDSWENKVLVLTQENQDKGERTPIEWLSGNKASLDNYLNFVSATYSFNQKKMEHLLSNGADKLEDWRSSAINDTRTITVYVKDLFERYLLFAKSKYKRTVFCVNGQITNYLGKVWGITKDRQADDKHHARDACLIAVAESNMLQEITKYFKWKYYFENNNVQKIDTQDGVAYIIKDTGEKLTEAEYDKYITKYVIEPYPNFRKELIARLCNNPQNPEKDCAFALHDCYLQYSDEQIKSIRPIFVSQMANHKATGKLFDDTIYGYSGKSDENGKQICTKKVSLTKLKLTKDKQQIENYYKQAMKDDPATYNAVLERLQKFDGNAEKAFGDPNNPLRKPTKNGEMGNEIKKVKLQIVADNCVSLKDRGVAKVDGMLRIDIFSKNNNGQKKYYAVPVYLIDVYKGQISTKVCAAGKSVSKWDDISNGYSFEFSLYSGDLFRLKFADKSISGTLQKDGKTKISTQEEYFYYKGFDRSTNTISFKTHDDSLEFRGIGFQSATIFEKYNVDLLGNISRVTSKKREMINKK

SEQ ID NO: 9122 - protein, 1155 aa, unidentified
  REGION 1..1155: note = Description of Unknown:uncultivated organism sequence
MYRLGLDVGIKSVGWCVLECDENGEPIQINALNSRIFDAAEQPKTGASLAEPRRNARGLRRRIRRKSFRLERIRKLFSENGIELFETQDDLICLKDEYKNLDVVKLRSDALDKNLTEAEFARVLYSLARHRGFKSNKRVVETDDGDEEKKGKGKNKDEGKLLSSIRESEEEMRESGMRTRGEQLYKKYLLEGKPVHNKGGDYSMCVSRDILVKEIELLFEKQKEFGNNFATDENKEKYLDIFLSQRNFDEGPGKGSQYTGSHDVKKCEIYRDEDVAAKGTYTSEWATIYQKINNLSIICGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINHLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKEKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNVIVKRTALANLKLDKNGEINGYFQPEGDVALYNALKQRLVEFDGDAKKAFATPIRKPCNSGQGNIVRTVKTYETYTGGGMLLEKNKGIVKNDGMIRVDLYSKDGKYFGVPVYVADLYRGELPKRAATANKPQNEWREMDDTYTFEMSIYQDDLLRIESKKGIELKKKKDVENSAKATSKTITDDFVYFIGFNRATGAMEIEDTSGCYYKDSVGIQNVGKITKCEIDVLGNVQEIKKRLKQPQPLKMLTDKERAEKRKNNQNK

SEQ ID NO: 9123 - protein, 1098 aa, unidentified
  REGION 1..1098: note = Description of Unknown:uncultivated organism sequence
MRKKIRYVLGLDIGIASVGWAVLLLDGEDNVCGIVRAGVHTFDEVTVGKEKITATANRRGYRSGRRLVRRKAHRIQRVKSLLQEMNIVSKKDMDEYYSGAVEDVYFLRWAAIQDEPVYILNSRELAQLLIYFAKHRGYKSTAVHEQEDEDDKKVLSAISENKKYMHEHGYRTAGEMIYKDAKFRQKRCGSSEENELLVARNSEGNYSNSISRDLLVEEVRIIFEKQRELGNTLATKELEERFLSIMQSQRNYDEGPGEGSPYGGNLIEKMVGECTFEKGEKRACKASYTSERFVLLEKINHLRICTADGNERPLNEDEKSAVIKLAYKTKVVKYNAIRKELKLDLEERFGGLTYSKVNNGDFKQRILDTEKKSDFISLKYWHEVKDILNLSYKDLTEEQKQLMDSVGKVLTYYKSEEKRREELSDLSLNQAQIEKMLKLNYAKFHNLSFKAMKKLMPELEAGYSYMESCLRVGYDSLSTDGVKTKYISKELLNEAVDKIMNPTVKRAVRRTVRILNEIVKLYGSPVEIHIEMARDLPHSGEVKKKIATAQKNNNKEKKEAIKFISENFGKTESDIRRKDILRYRLWKNQSQMDLYSEKLIPVEDILDYEKYEVDHIIPYSRSFNDSFNNKVLVKKKDNQDKKNHTPHEYIGHDDEAWNKFVKMVNNYVLSPEKRKNALTKSSDSDEWRSRNLNDTRYTTKVVADLIRRHLVFEPYFNRARNKHVYPLNGGVTARLRHEWGLEKDREKSDKHHAQDAIVIACCTEKMIWKMSNIYKQEELGGVVRKGNKLVDRRTGEILETIALPWKWFREEVEMVMADHPEDYIERAKDRGYMGDIPKSIFVSRLPVKKKTGVISENTIRVVDEASSRTVEKTSLDKLKLIEVNGKKQIKDYYRPEDDVLLYNKLLDRLIRYGNAKDAFAEPFYKPKKDGSDGPIVKKVKLYVGVADDQVKVRGRGEDIDREGVKDRGGMYRCDIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 9124 - protein, 1131 aa, unidentified
  REGION 1..1131: note = Description of Unknown:uncultivated organism sequence
MYRLGLDIGIKSVGWSVLDCSENGEPTKIIALGSRIFDAAEQPKTGDSLAEPRRMARGNRRSLRRRAARLIYIRRLFADNGIDIFDKNDDTQIKEELRNIDVLSKRVEALDKRISEEEFARVLYSIARHRGFKSNKKKGARKEEDGKLLEAIKANNAKMKKLNLRTVGEYLYKEYGEKGKAVHNKGGQYNMCVARDDLEREVKLLFAKQKEFGNKFATDDNLEKYLTYFTKQRTFDEGPGEGSQYSGSHAVRKCTFYKDEDCAAKGTYSNELSTAYQKINNLKIVVDGDRFNLNEEQKAVIINKAHEKETLTYKDVRKLLGYDKNELVTFSVLNYSVRPKKKKDGTIEEVDPFKCEDAKFISLANSNKIRKALPNELKDDNALIDEIAEICTKYTNENLFKEAIANSKIINNRLSNEVIDNLLEIDMKGYGHLSLKALREILPYLKDGDVYSDACDKAGHNHSQFNNEKGKYLGKNQEVREAIDKLTSPVVKRALSQTIKVVDAIIREYGSPYAVNIELAREMAKSRKERDEITQNNNERAADNERIKAQLKEMGLTVNFTNVLKKKLYEEQGQKCMYSGKDIVFERLMKDDKYCEIDHIIPYSRSFDDSFNNKVLVFASENQNKKNDIPFEYFERIGRDWEEFESRVKTTYQKRNAKKLELLLKKKFDEEGWKNRALNDTRYITKMLSNLVRDYLIFDERAKKKCVLTVNGKITAYLRRFWGIQKIRADGDKHHAVDAAVIACVSDKIIQKVTDYNYVKESRMMNDGKYVLEDGEIASAEWYDKKNNFILPYPYSVFRDELAARTLDSVTDMKNRLQEIGMSEEYIESAKPFIVSRMSHRKAKGVIHEATVWSSKYVDNKNKNLHNGESIIVKRTPIENLKLDSNGEIKNYFKPDGDIALYNVLKTRLIEFNGDGKKAFATPIYKPCNKDKKPNAIRTVKTYEKYFGGGMKIEKNSGIVANGSMIRVDLYSKDGKYYGVPVYVADLYKGVLPKRAATAGKPRSEWRLIDDTYTFEMSIYPNDLLRIESNKEIKMTKEYTDEFSPKVNEITFMDNIVYYVKFGISTASITIEDVAGCYLAPSVGIQNLKKITKCEIDVLGNVVEIKNKPKSPQPLKLITEQERREKRKQNK

SEQ ID NO: 9125 - protein, 776 aa, unidentified
  REGION 1..776: note = Description of Unknown:uncultivated organism sequence
MKKDGTEETPNPFKCEEAKFISLANSNKIKNCLREELKNNIEVVDAIAEICTKYTSENLFRKAIIDSNLLNGILTEEEIVKLLDIDMTGYGHLSLRALREILPYLQEGYVYSEACKKAGHNHSQFDTSKSKYLGKNDDVRAQIDEVTSPVVKRALSQTIKVVDAIIRKYGSPFAVNIELARDMSQTRQERDKADKENRDRAADNERIKAKLEGEFNVRISSTNLLKYKLYEEQNGKCAYSGETIDLNKLFADDKYCEIDHIIPYSRSFDDSFNNKVLVLSKENQNKRDSIPYEYFTRIGRNWEEFEGFVKTTFKYNRRKAELLLKKKADEEGWKTRALNDTRYASRMLTNLVKDHLLFDEKSKNRPVLSVNGKITSYLRRFWGIQKIREDGDKHHAVDATIIACVSSGIIQKLTNYNYVKESRNMKNGEYVLEDGELVSSEYYDKHSNLVLPYPYPKFRDELIARVADNAVEMEIKLRDIGMDDEYVSAAKPIVVSRMPHRKVKGTMHEATVWSSKYIDNDNTKIHDGESILVKRTPIENLKLKNGEIENYFNPESDKLLYDAIKQRLKDFDNDGKKAFAEPLYKPCASGQGNIVRTVKTFEKYYGGGMQIDKNKGVVANGSMVRVDLYSKDGKYYGVPVYTADVYKGVLPNRASTAGKARKDWRVIDDTYTFEMSIYPNDLLHIESKKEITLNKDLKNEFSPKSDEYCFTKGLVYYNMFDISGARFTIEDTTGCYKGRTAIQGLAKITKCEIDVLGNVVEIKNKPKAPQPLCMKK

SEQ ID NO: 9126 - protein, 864 aa, unidentified
  REGION 1..864: note = Description of Unknown:uncultivated organism sequence
MSDAAETVGGDRRRLSNEERQIAVELAKKVDKVTYKAFRKAIKLDDDYRFSALNYSEKKKSDKKKNEGESKSDVVEINDVVDSLACEDKGDFITAKNSNKIVKALNDNLKSDIELIDEIAEICTKYKSENLFRSAIAESKIIDGRLDEETIEKLSKIDMKGYGHLSLHVLREILPYLEEGMVYSDAMQKAGHNHSEHNFEKQKYLGTKEVYDAIGGVTSPVVKRALSQTVKVIDAVIRQYGSPYAINIELARDMSMSKDERDKLKKENDARAAKNEAIRENIAKLNAMPNSTNVLKYKLYEEQDHKCAYSMETLDINQLFEDGYYEIDHIIPYSRSFDDSFNNKVLVLKRENQNKRNSTPVEYFERIGRDYDEVLAFWKAVYQKRNRKKLEFLQKKEINESEWKNRALNDTRYASRMLANLIKDYLLFDEKSKDKYGRVETVKGAITSYLRRFWGVQKIREDGDKHHAVDAAIIACVTPKTKNKIERYNQIKESRKMRNGQYVLEDGEICDSDYYDKNSHLVLPYPYKEFINELDARVMDEPVLMQNKLRLLGFNENYLMNAKPFVVSRMTSRKAKGCINEATVFSSKYADNKYPTVCDGNNIIVKRTALANLKLDKNGEINGYFQPEGDAALYNALKQRLVEFDGDAKKAFATPIRKPCNSGQGNIVRTVKTYETYTGGGMILEKNKGIVKNDGMIRVDLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 9127 - protein, 1144 aa, unidentified
  REGION 1..1144: note = Description of Unknown:uncultivated organism sequence
MVLGLDVGTASIGWGLVKLREEEYPSTNKNGQPDTKPKIVGGEILKTGVRTFKEPEDDKGKSLAITRGLARRGRWRIKRNVQRLKNLIKLAKEFNLVSNDLVRGEILEMLKTDKGVNKKEKWDIWGIRKEALERKLSDTELFRVLYHIAKHRGSYFHMKAEFLPDEEAPKNKKQKKEGADEKEKVKKGLRQIQKMLKDSPYKTIGALFYATFKQTNPKGSNKKRNAPGEYTHSIRRELLRDEIEIIFQEQQRLGNTKAKPELLEKYIDDILMYEKEADEDKLRNMMGRCEFEFDEDGKGKVLAPKESYTSEKFTLFNRLNSLTFGGGKDDIQRDQIIALAHKNAKVTFSQIRNELKLQEKLHLTFNLCSYAEKNPEYKTKLECEIRNNQLQFEDKHKLSIVNINTGETSSIENEIKEIFIKKFNPEYKKIYVYYSDIRKQLNLSGDLRFTNLKDYTKSIAEFEREYNEKNKKNPKPFNGQAEYIKQFEDKDVFVKLDGYHKIKNTLETIDSKWQQIKDNADKLDIIAEAVTYCKSDKTRTEYLRQHGITDKSIIDAVLTIDMSGLANFSKQAMNNLLKYMDGNGDGHLLFHEAKEKCGYGKKDYEKQAVLQPYKGFFEKNPVVARVISQTRKLVNAIVRDCKDEYAIDQIHIEVATELANSKDRKIDIITGQRRYKEEKVAAEERCMKWDIDPDKGDNLLKFRLAEQQGNECPYTGKKIMFASTTGNDAVYILDCEIDHVIPMSRSFNDSLNNKVLCSPEANQNKRDRIPYEWFEERYGKESEQWHIFENRVKKMYGVPYPKKKNLLRKSWTDEDKERFLSRNLNDTRYAARHIADYLRKYFDFSKSRIEIKDESRIQLRSGGITAFLRHIWGLNKDREANDLHHAIDAIVVACSTYGHVFLVSNLSKEMERKGKSWFKHFNFLREKFKPWKNIREDILSNVNQIFVSRMPRHKVTSAAHEDTVSRLDNKNPPKNRHIKINKGYAKIGEMVRADVFVDKDGMNYVVPIYAVDMFSKNLLPDKYVPDDSKVPYDEWPSADIFDFKFSLFKDDLIGINNKMYYVSFFEAATTNVNVKNIDGSMFPDKMDAQDPYTKKICYRPKSKTRKCILKKYSIDTLGNHKEIEQETRLGNDRVKRGKKPKKNG

SEQ ID NO: 9128 - protein, 1106 aa, unidentified
  REGION 1..1106: note = Description of Unknown:uncultivated organism sequence
MGEIMNKEKVVLGLDIGVGSIGWGLVKITEEEYCDEKDDGTIDKKHRITDGTIIDTGVRAFQIPQDRQKKSLALQRGTARRSRRTTRRKAQRLKLLIKLAKEFNLIDNNFYRDEILKPKKGDKECDWDIWFIRKKALEEELSDAELFRVLYHIAKHRGFYFHTKSEEIQEEDKKSETGEVKKGLVRIRKKLEDGGWETVGQMFCEEFKQTNKENKRKRNAQDKYGNSIHRSLLKEEIEKIFEKQQKLGNNKTKEELKKRYIDEILMYEEGIDENKLRKMMSHCEFTGDLCAPKESYTAERFILFNRLNTLELVDTQDKDRHLLLDDDKQRKKIEALAYKNSKVTFAQIRTELELQDNLHIRFNLCSYSEKTPEYNKKLVCNIKDGRPDFEEKHKVSIVDIYTGEVKVLDAEIKNIFNRKTLMPNSKKIYVYYSDIRKQLKLSSDFRFKDLSGYTKSAVEFGSEAKYVKQFENDTFIELKGYHKIKKAIEDKCGKEKWEHISSNITKLDTIAESLTYCKSDETRTEYLHQHNIIDKEIIDAVLKINMKQVASYSREALEKLLENMEKGDLFQEAKEKANFPKSEYEKRAILKPYSGFFENNPVVARVISQARKLVNALVRKYQKQYLINQIHIEVATELANSEKRKNQIAQGQKRYKDDKEAAEERCREFNLDPEEGQNLLMFRLAEQQLNKCPYTGKTITFYPTAASNEVYIKDCEIDHIIPMSRSFNDSLNNKVLCSPEANQNKTNRIPFEWFEETYGKNSQRWAEFENTVKKMYEMPYPKRKNLLRKSWTDKDKEKFLSRNLNDTRYAARHIADYLRKYFDFSKSKRDEIKEVNRIQLRSGGVTAFLRHMWGLNKNREENDLHHAIDALVVACSTYGHVYLVSNLAKEIERKGKNWYKHFGRDKFKPWGNIREDVQAAVDKVFVSRMPRHTVTAAAHEETIISKEKISKNRTIKIRGGYAEMGDMVRADVFVDNVGKNYVVPIYSVDIFSNKPLPDKYLHKNDAPYDQWPSVKEGKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 9129 - protein, 1117 aa, unidentified
  REGION 1..1117: note = Description of Unknown:uncultivated organism sequence
MNKEKVVLGLDIGVGSIGWGLVDIEEQEYVDEKADGTIEKKNRIVDGQIIATGVRTFHVPQDEKGKSLALKRGTARRSRKTTRRRAQRLKQLIKLAKEFNLIKKNFDRDAVLKAKKGDKESTWDIWTIRKEALERKLSDVELFRVLYHIAKHRGSYFHTKAEFLPEEDEKKLKKEQSEEEKEKEKVKKGLRRIRKMLKDSEYKTIGVLFYETFKNERKRNAPDKYEHSIRRELLCDEIIEIFKEQQKRRNNKAKNDLKKRYIDNILMYEEGIDEAKLQKMMGRCEFTGGVCAPKEGYAAERFTLFNRLNTLRLVDTQNKDGDVQLDKNQRDKIEALAYKNTKVTFSQVRNELKLENDLGKRFNLCSYREKDPEYNKKLTCNVKDGHPDFEEKHKLQIVDINTGAITVFDEEIREIFRKRKETYKNAKKLYVYYSNIRKQLNLSGDFRFAGLEGYTKSEAELGGKAKYIKQFEDDTFVELKGYHKIRKAVEKLCGDSKWEELAADTRNLDIIAESLVYHKSDETRTRCLRENGVVDEDIVNAVLTINMKQVDRYSKEALGKLLEYMEQGDLFNEAKEKAGFGKIEYEKQAILKPYNGFFENNPVVARVISQTRKLVNALVRKYQEQYPIDQIHIEVATELASSEKRKAQISQGQRRYREEKESAAQRCGEKGFDPEEGQNLLYFRLAEQQNYFCSYTGTKITLQPTGAANEVYIKDCEIDHIIPMSRSFNDSLNNKVLCTQQANQEKREKIPFEWFEEMYGKDSQEWMEFEKRVIKMYGMPYAKRRNLVRKSWTEKDKEGFLSRNLNDTRYAERHISDYLRKYFDFSKSNRDDIKDVSRIQVRSGGITAFVRHMWGLNKNRGADDLHHAIDALVVACSTYGHVYLVSNLARKMERKGKNWYKHFGRDKFKPWESIREDIQRAVGNVFLSRMPRRTVTGGGHKETVVSKAKASKKRVIEVNLGYVEMGDMVRADVFADAAGKNYVVPIYSVDIFSNKPLPDKYVPDDNSLTYEQWPRVKESNLKFRFSLFKDDLISVNDKMYYVSFVEAGTVNINVKNIDSSIFPDKKDATDPYTKKIGYRPKSKTKKRVLKKYSVDMLGNYKEIRQEKRLGNRFKSGV

SEQ ID NO: 9130 - protein, 1131 aa, unidentified
  REGION 1..1131: note = Description of Unknown:uncultivated organism sequence
MNKEKVVLGLDIGVGSIGWGLIQIKEEEYSDKKSDGSIDKKHRIIDGEIIDTGVRAFQMPQDRQKKSLALQRGNARRSRKTTRRKAQRLKNLIKLAKEFNLIDDNFDRDAYFKPNKGDNETNWDIWTIRKESLERKLTDIELFRVLYHIAKHRGFHFHTKSEFLSEEDEKKIQKGKKQGAEENEKEKEDKKVKQGLRRIEKLLKEGGYRTVGQMFYEKFKQTNPDKKRKRNTPDKYENSIQRSLLKKEIEIIFEEQQKMAHLMAKEELKQQYIDDILMKEEVIDEKKLKNMMRNCEFVPKEKCAPKESYIAERKVLFDRLNTLELVDTQNKDRHLQLDKDQRDKIVALAYKNVKVTFAQIRNELGMENDLDKRFNLCSYKEKDPEYNKKIDCEILNGKLKFSEKHKVPIVDIDTGEVKILDEEIKNIFESKKKLWPKAKKISVYYSDIRKQLNLPGDFRFANLKGYTKSAAELGSEAKYLKQFEDDTFVELKGYHKIKNAIEKDCGKEKWSELAEDEDNLDVIAEALVYHKSDETRSQYLKGKGIVDADIINTVLKINMKQLANHSKEALKALLKYMEKGDLFNEAKEKCGYGKIDYKKQAILQPYKGFFENNPAVARVVSQTRKLINAIVRKYNDQYPIDQIHIEVATELASGKKMRNNISQGQRRYLEEKKAAEERCREKGLDPEEGQNLLMFRLAEQQNYFCPYTNTKITLYPTGAVNEVYIKDCEIDHVIPMSRSFNDSLNNKILCTQKANQDKKDRIPFEWFEGMYDRDSKEWTEYENRVKKMYGVPYSKQKNLLRKSWTEKDKERFLSRNLNDTRYATRHIADYLRKYFDFSKSQRDDIKDVSRIQLRSGGITAFLRYMWGLNKDREENDLHHAVDALVTACSTNGHVYLVSNLSKEIERKGKSWYKHFGWVRDRFKPWNNIREDVQKAVENVFVSRMPRHTVTAAAHEETIISGEEQDKNRTLEVRGGFAKMGDMVRADVFMDEEGRNYVVPIYSVDIFSKKPPPDKYVPDDYSLSYERWPSVKDDNQKFKFSIFKDDLISLNGKMYYVSFFEASTVNVNVKNVDGSIFPDKKDALDPYTKKICYRPKRKGRKCLLKKYSVDILGNYKEIKQEKRIGNRFKDVV

SEQ ID NO: 9131 - protein, 1108 aa, unidentified
  REGION 1..1108: note = Description of Unknown:uncultivated organism sequence
MINQKNILGLDIGIGSVGWGLVQLSEDKYMDEKADGTVLEKYKICDGKIIDTGVRTFQVPQDRQKKSLALKRGLARRSRKTIRRKARRLKSLVKLAREFNLITGDFNHDNVLKPKKGDKEKKWDIWFIRKEALERKLTDKEFFRVLYHIAKHRGFYFHTKSEELKKEEKGSETGKVKAGLIRIRNKFEDSNWKTVGQMFWEEFNQINTENKRKRNAKDKYQNSIPRLLLKEEIKAIFKRQKELRNPKAKEKFKLRYIDEILMNEESIDEYRLQKMMNKCEFIKDELCAPKESYTAERFTLFNRLNTLELVDTNNKDRHLALDDTQRNKIEALSYKNTKVTFAKIRTELGLQDDLHIRFNLCSYSEKNPEYNKRIECEIKKGQLQFDQKHKVPIVHINSGEIRALDREIKKIFHSKKLWPNSKKIHVYYSDIRKQLNLSDDFRFADIIRGYTKSVSELGSEAKYIKQFEKDTFVELKGYHKIKKAVVEHDSENKWAELAADTNSLDIIAEALVYHKSDKTRTEYLEQNGFVDKDIIDAVLTINMKQLANYSIEAIRKLLVFIEKGDLFNDAKEKAGFGKIEYEKQPILKPYNDFFENNPVVARVISQTRKIVNAIVRKYNSKYPIDQIHIEIATELASSEQRKIKIQQGQNRYREDKEAASERCREAGIDPEEGQNLLMFRLAEQQNYFCPYTGTKITLYPTGAANEVYIRDCEIDHVIPMSRSFNDSLNNKVLCTQKANQDKRDRIPFEWFEEMYGKDCRKWAEYEYTVKKMYGMPYPKRINLLRKSWTDKDKEKFLSRNLNDTRYAEKHIANYLRKHFDFSKSLRDDIKDVNRIQVRSGGITAFLRHMWGLNKNRSENDLHHAIDALVVACSTYGHVYLVSNLSKAIERKGKNWYKHFGRDKFKPWTNIRDDIQDAVDNVFVSRMPRHTVTASAHKDTIISKGKANKKRIIEINSGYAEMGDMVRADMFVDKDGKNYIVPIYTIDIFSNKPLPEKYLNKNNASYDQWPSINEGKLKFRFSLFKDDLISINNQMYYVDYTRATRSKISIKKVDGSLINKMKGEKTKETGYRNVELKKYSVDMLGKYKEIKQEKRLSNRFEHQNKALQN

SEQ ID NO: 9132 - protein, 1108 aa, unidentified
  REGION 1..1108: note = Description of Unknown:uncultivated organism sequence
MINQKNILGLDIGIGSVGWGLVQLSEEKYMDEKADGTVLEKYKICDGKIIDTGVRTFQVPQDRQKKSLALKRGLARRSRKTIRRKARRLKSLVKLAREFNLITGDFNHDNVLKPKKGDKEKKWDIWFIRKEALERKLTDKEFFRVLYHIAKHRGFYFHTKSEELKKEEKGSETGKVKAGLIRIRNKFEDSNWKTVGQMFWEEFNQINTENKRKRNAKDKYQNSIPRLLLKEEIKAIFKRQKELRNPKAKEKFKLRYIDEILMNEESIDEYRLQKMMNKCEFIKDELCAPKESYTAERFTLFNRLNTLELVDTNNKDRHLALDDTQRNKIEALSYKNTKVTFAKIRTELGLQDDLHIRFNLCSYSEKNPEYNKRIECEIKKGQLQFDQKHKVPIVHINSGEIRALDREIKKIFHSKKLWPNSKKIHVYYSDIRKQLNLSDDFRFADIIRGYTKSVSELGSEAKYIKQFEKDTFVELKGYHKIKKAVVEHDSENKWAELAADTNSLDIIAEALVYHKSDKTRTEYLEQNGFVDKDIIDAVLTINMKQLANYSIEAIRKLLVFIEKGDLFNDAKEKAGFGKIEYEKQPILKPYNDFFENNPVVARVISQTRKIVNAIVRKYNSKYPIDQIHIEIATELASSEQRKIKIQQGQNRYREDKEAASERCREAGIDPEEGQNLLMFRLAEQQNYFCPYTGTKITLYPTGAANEVYIRDCEIDHVIPMSRSFNDSLNNKVLCTQKANQDKRDRIPFEWFEEMYGKDCRKWAEYEYTVKKMYGMPYPKRINLLRKSWTDKDKEKFLSRNLNDTRYAEKHIANYLRKHFDFSKSLRDDIKDVNRIQVRSGGITAFLRHMWGLNKNRSENDLHHAIDALVVACSTYGHVYLVSNLSKAIERKGKNWYKHFGRDKFKPWTNIRDDIQDAVDNVFVSRMPRHTVTASAHKDTIISKGKANKKRIIEINSGYAEMGDMVRADMFVDKDGKNYIVPIYTIDIFSNKPLPEKYLNKNNASYDQWPSINEGKLKFRFSLFKDDLISINNQMYYVDYTRATRSKISIKKVDGSLINKMKGEKTKETGYRNVELKKYSVDMLGKYKEIKQEKRLSNRFEHQNKALQN

SEQ ID NO: 9133 - protein, 1098 aa, unidentified
  REGION 1..1098: note = Description of Unknown:uncultivated organism sequence
MNKERIVLGLDIGIGSVGWGLVKLNEQKYEDKKPNGDVYTKYRIKGGEIIDCGVRSFQVPQDRQKKSLAVKRGMARRARKATRHKAQRLKRLIRLAKEYGLIGEDFSREKDLKPKKGDTEEKWDIWHVRNRALEEKVTDLELFRIMYHIAKHRGFYFHTKAEEMKEGDKNSEEGKAKKGLARVQKKMEKGGWETVGQMFCEEFKQTNKKNKRKRNSENNYKNSIHRSLLKDEIEKIFARQKEFGNEKAKDILKKRYIDEVLMYEKGIDDEKLQRMMKKCEFTGKICAPRKSYTAERFKLFNRLNSLEIVNTRKRNEPNELKEEQVSKIAELAYEKNKVTYSQIRKCLGLEDELHKRFNMCSYRGKNPEYEKKLSCDVKNGRPEFNAKHKLELVEIETGEIKPIGEHVQQLFKRRAKRRLNSKKISLYYSDIRKSLNISNNYRFSNLNGYIKSATELGSEAKYLKQFEKDTFVELKGYHEIRKTIQKNCDDGKWDEIASDVKTLDTIAEALVYHKSDETRREYLNGNGINDEELIEAVLTMNMKEVHNFSKQAIRKLLVHMEKGYLFNDAKEKAGLNGQEYDKQPILKPYSGFFENNPVVARVISQTRKLVNAIIRKYQNDYPIDQIHVEVATDVAKSEKNKRKIENKQRRYQEEKQAAIERCEEFGIDPFKGQNLLKFRLAGQQNYRCPYTNRAITLYESGVEDEVHLDDCEIDHILPMSRSFNDSLNNKVLCTQKANQEKRNQIPYEWINKSQGPKKWHEFELRVNNMVLLPYGKKRNLLRKQLTEEDKEEFISRNLNDTRYAAKHFADYLRKYFDFSKSRRDDIKEVSRIQLRSGSITAFLRHMWGLNKIREENDLHHALDALVMACSTYGHVYLVSNLSKQIEEKGKHWYKHFGRDKFKPWDDIRMDIEESVEDVFVSRMQRHKVTGAAHKETVLKKKEESKKRVIEVNGGYAEMGEMVRADVFVDEKGKNYVVPIYSVDIFSNKPLPNKYLNKNSAAYRDWPSVKDDNLNFKFSLFKDDLISLDGKMYYVDYVRATRSVISLKKPDGSDFEKTGKNAKEASYRNAELRKYSADLLGNYKEIKQEKRLGNRFGRK

SEQ ID NO: 9134 - protein, 1139 aa, unidentified
  REGION 1..1139: note = Description of Unknown:uncultivated organism sequence
MDNERVILGLDVGIGSIGWGLVKLKEEKYPVEKPDGTTGEKYKITDGEIIDTGIRTFALPQDREGKSLAAKRGQARRIRWTIRRKARRLKQLIKLAKEYKIIGSDFNRNEFFKLKEGDDKEKWNNWRFRKEALERKLTDEEFFRVLYHIAKHRGFFFHTKAEFQIDGKEKGIRGNKEEKETSERDREDEKVKQGLRRIQKLLKESGYTTVGEMFWKIYSDEKTHNKRIRNAEGKYENSIYRPLLRDEIEEIFKAQQRFGNTKAKNELKERYIKDILMKEEPIDEDKLRKMMRQCEFIPDKECAPKESYTAERFTSFNQINTLELIDTKNKGRIALDKEQREKIEALAYKNAKVTYSQIRDELGLGDKLHIRFNRNIYTEKNPEYDKKLKCEVEEGKLQFDENHQITINTDTGEIILDREIKNLFQKRFRPNYNHVTLYYSDIRRELENSEDFKIKDFRFKKFQKEYTKSEKELKSKAEYIKQFEDETFIELKGYHKIRKAIEKNCGEEKWRQISSDREKCGEMIDMIARAMTYCKSDETRTKDLKDNGITDQGVIDAVLSINMSGLANFSKEAMSNLLKYMDKERMLFNDAKKKCGYGKIEYKKQAKLEPYSGFFEKNPVVARVISQTRKLVNAVMAKYNRQTPIDHIHIEIAKDLANSEERKAEISRGQDRYKKAKEAAIEECRKKGLDPEEGQNLLMFRLAEEQNYFCPYSGKKITTYSTGAANEIYIGDCEIDHIIPMSRSFNDSMNNKVLCSPKANQEKQDRIPYEWFDVQYGKDSQEWSNFENTIKKKYGMPYPKRKNLVRKSWTEEDKEKFLSRNLNDTRYAARHIADYLRKYFDFSVSEREDIKEVSRIKVRSGGITAFLRYMWGLSKDREENDLHHAIDALVVACSTDGHVYWISNLSKATERKEKNWVEHYKSIKSKFKPWPSVREDIQNKIDKVFVSRMPRHKVTGGAHKDTISSLKEMPSNKRVIKVNKGYADIGEMVRADIFTDDNGKNYVVPIYATDFFANRPLPDKYVPDDRLMPYEEWPNVVDKTLKFKYSLFKDDLISINGTMYYVSFFEATTTNVNVKNINGSIFIDKKDAQDPYTKKITYRPKKGKCILKKYSIDMLGNYKEIEQEKRVGNIFENGTKRGP

SEQ ID NO: 9135 - protein, 1140 aa, unidentified
  REGION 1..1140: note = Description of Unknown:uncultivated organism sequence
MNNERIILGLDIGVGSVGWGLVKLKEEKYSDKNQDGTVSEKFRIIDGKIIDVGVRTFQLSQDEKGKSLAAKRGQARRSRWTIRRKAKRLKQLIKLAKEFDLISNNCDPYEILKPNKGDNKKEKWDIWRIRKEALERKLTDEEFFRVLYHIAKHRGAYFHTKAEFLPEEDEKKLAEDKKQEESKEEQEKEKVKKGLRKIEKMLKNSGFNTVGKLFYESFKNARKRNAPDKYEHSIHRELLRDEITEIFKEQKKFGNEKADPELAKRYIKDILMKEYDIDEKKLQNMMSRCEFTNEICAPKESYTAERFALFNRLNTLETIDTENKNKAIFLSSEQRGKIENLAYTNAKVTFAQLRNELKLQDKLHIRFNLCSYAEKNPEYNKKLICEIKNEQVQFEGKHRLPTIDTDNSDINILDDEIKKIFKAKKLWPKAKSIYVYYSDIRKQLNLSEHIRFGYFDKKDGAIKELKGYTKSASELGSEANYIKQFEDDTFVELNGYHKIKKSIEEKCGTEKWKQISKEAIKLDTIAEALTYCKSDKTRTEYLQQHNITEHGIVDAILTINMKQLATYSKEALSNLLKYMDKKEEWMFFNDAKEKCGYGKIDYKKQMILEPYSGAFEKNPVVARVISQTRKLINAIVRKYNSIYPIDQIHIEVATELANSKKRKAKIAEGQKRYKDDKLEAERRGREKGLDPEEGQNLLMFRLAEQQRQLCPYTEKHITFQPTGATDEVYLKDCEIDHIIPMSRSFNDSLNNKVLCASEANQNKRNRIPFEWFEERYGKNSQKWSNFENRIKKMYRMPYPKKKNLLRKSWTDKDKEKFLTRNLNDTRYAARHIADYLRKYFDFSESERDDIKDVSRVKVRSGGITAFLRYIWGLHKEREENDLHHAVDALVVACSTDGHVYLISNLAKEIEKKGKNWYKHFDFIRNKFKPWATVREDIQSKANNVFISRMQRHKVSAAAHDDTIRSFKELSENKRIIKVNKGYAKIGEMVRADVFMDNESKNSVVPIYASDIFANKPLPDKYVPDDRLLPYENWPSVFDKGLKFKFSLFKDDLISIDNKKFKDKKFYVSFFEATTTNVNVKNIDGSIFQDKKNAKDPKTKKITYRPKREKCILKKYTVDMLGNYKEVVQEKRQGNRFENRL

SEQ ID NO: 9136 - protein, 1106 aa, unidentified
  REGION 1..1106: note = Description of Unknown:uncultivated organism sequence
MGEIMNKEKVVLGLDIGVGSIGWGLVKITEEEYCDEKDDGTIDKKHRITDGTIIDTGVRAFQIPQDRQKKSLALQRGTARRSRRTTRRKAQRLKLLIKLAKEFNLIDNNFYRDEILKPKKGDKECDWDIWFIRKKALEEELSDAELFRVLYHIAKHRGFYFHTKSEEIQEEDKKSETGEVKKGLVRIRKKLEDGGWETVGQMFCEEFKQTNKENKRKRNAQDKYGNSIHRSLLKEEIEKIFEKQQKLGNNKTKEELKKRYIDEILMYEEGIDENKLRKMMSHCEFTGDLCAPKESYTAERFILFNRLNTLELVDTQDKDRHLLLDDDKQRKKIEALAYKNSKVTFAQIRTELELQDNLHIRFNLCSYSEKTPEYNKKLVCNIKDGRPDFEEKHKVSIVDIYTGEVKVLDAEIKNIFNRKTLMPNSKKIYVYYSDIRKQLKLSSDFRFKDLSGYTKSAVEFGSEAKYVKQFENDTFIELKGYHKIKKAIEDKCGKEKWEHISSNITKLDTIAESLTYCKSDETRTEYLHQHNIIDKEIIDAVLKINMKQVASYSREALEKLLENMEKGDLFQEAKEKANFPKSEYEKRAILKPYSGFFENNPVVARVISQARKLVNALVRKYQKQYLINQIHIEVATELANSEKRKNQIAQGQKRYKDDKEAAEERCREFNLDPEEGQNLLMFRLAEQQLNKCPYTGKTITFYPTAASNEVYIKDCEIDHIIPMSRSFNDSLNNKVLCSPEANQNKTNRIPFEWFEETYGKNSQRWAEFENTVKKMYEMPYPKRKNLLRKSWTDKDKEKFLSRNLNDTRYAARHIADYLRKYFDFSKSKRDEIKEVNRIQLRSGGVTAFLRHMWGLNKNREENDLHHAIDALVVACSTYGHVYLVSNLAKEIERKGKNWYKHFGRDKFKPWGNIREDVQAAVDKVFVSRMPRHTVTAAGHEETIISKEKISKNRTIKIRGGYAEMGDMVRADVFVDNVGKNYVVPIYSVDIFSNKPLPDKYLHKNDAPYDQWPSVKESKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 9137 - protein, 1106 aa, unidentified
  REGION 1..1106: note = Description of Unknown:uncultivated organism sequence
MSNEKIVLGLDIGIGSVGWGLVKLIEQKYVDKKPDGEVIERYKISDGKIIDTGIRAFQVPQDRQQKSLALQRGAARRSRKTTRRKTQRLKRLIRLAKEFNLLTEDFNRDQVLKPKKGDKESTWDVWLIRKQALERKLTDSELFRVLYHIAKHRGFYFHTKAEEMQKEDASSETGKAKAGLARISKKLEDGNWKTVGQMFCEEFKQTNKDNKRKRNAEDKYENSIHRTLLQDEIMKIFKKQKELGNPKAKEELKQRYIDEILMYEEGIDEDRLQKMMSKCEFTGGLCAPKESYTNERFILFSRLNTLGLVDTQNKDRPLPLDDKQRGEIEALAYKNAKVTFAQIRKELGLQEDLHIRFNLCSYDEKNPEYNKKLGCEIKNGQLKFNEKHKVSVVDINTGEIRKLDAEIKKIFKSKKFWPNLKKINVYYSDIRKQLNLSSDFRFENLLKGYTKSVVELGSEAKYIKQLEDDTFIELKGYHQIRNAIEKKCGKEKWEQISKVTAKLDVIAEALTYHKSDETRKEYLHQHNIADEEIIDAILTINMKQLANYSREALEKLLENMQKGDLFYEAKEKADFPKSEYEKQAILKPYSGFFENNPVVARVISQTRKLINALVRKYNDKYPIDQIHIEVATELANSKKRKNQIAQGQRRYREDKEAAAERCREFGLDPEEGQNLLMFRLAEEQNNLCPYSGMAITYYPTGGDNEVYIKDCEIDHIIPMSRSFNDSLNNKVLCIQQANQNKRDRIPFEYFEDTYGKDSAQWMEFERRVKKMYGMPYPKRRNLIRKSWTEKDKEKFISRNLNDTRYAARHIADYLRKYFDFSKSQRDDIKKVNRIQVRSGGITAFLRHMWGLNKDRDKSNLHHALDALVVACSTYGHVYLVSNLAKEIERKGKNWYKHFGRDKFKPWNNIREDIQKAVEKVFISRMPRHKVTAEAHKETITSLKETTSTKRITMINGGYAEMGEMVRADVFTDDEGKNYVVPIYTVDIFNNKPLPDKYLHKNDALYELWPSVTENNLKFKFSLFKDDLISIDGKMFYVNCISGTRSNIEVKNIDGSIFRSTSDREREFGYRNVELKKYSVDMLGNYKEVKQEKRLGNRFENNKKQVI

SEQ ID NO: 9138 - protein, 1153 aa, unidentified
  REGION 1..1153: note = Description of Unknown:uncultivated organism sequence
MNKERIILGLDIGVGSVGWGLVKLTEEKYYDERTDGTSQERYRITDGKIIDAGIRVFQLPQDKEGKSLAAKRGLARRSRWTIRRKAKRLKKLINLAREFDLIGNNFNYDEVLKPKKRNNKDEKWDIWRIRKEALERKLTDTEFFRVLYHIAKHRGAYFHTKAEFLPEEDEKELKKNKTKEKEGNKKENEKEKVKNGLRKIKKMLRDRKYKTIGVLFYETFKQANSKGNNRKRNAPDKYEHSIHRELLCDEIVEIFKEQQKYGNTKAKEELRLQYIDNVLMYEEPIDEEKLRKMMGKCEFVPGADLAPKESYTAEKFSLFNRLNTLAMVDGHNKNNLQTLDAPQRDKIIALAYENAGGVTFTQIRTALELEDKLHITFNLCYYAEKNPEYNKKLKCEIKNGQLQFEEKHSLPIVNIDTGEVETLDKEIKDIFIKKFNPKYKKIYLYYSDIRKQLNLSDNFRFADLKGYTNSIAELKRENEEKNKNKKNKKPFNGEVEYIKQFENDTFIELKGYHKIKNAIEKNCSEEKWQQIRENTVKLDTIAEALTYCKSDETRANYLREHNINDKEIINAVLTINMKQLARYSIVALSNLLKYMESGALHNDAKEKCGYGKIDHKKQTILEPYKGFFEKNPVVARVISQTRKMTNAIVRKYNDKYPIDQIHIEVATELANSEKRKNEISQGQRRYKEAKEAAEERCKEYGLDPEEGQNLLMFRLAEQQNYFCTYSSKKITLHSTGAVNEVYIKDCEIDHIIPMSRSFNDSLNNKVLCAPEANQNKRDRIPFEWFEKTYGKDSQQWRDFENTIKKMYGVPYPKRKNLLRKIWTEKDKEKFLSRNLNDTRYAARHITDYLREYFDFSISERDDIKEVSRVKVRSGGVTAFLRYMWGLHKDREANDLHHAIDALVVACSSDGHVYLVSNLSKEIEQKGKNWYKHFDFIRNKFKPWATVREDIQSKANNVFISRMQRHKVTAAAHEDTVRSLTEVSENKRIIKVNKGYAKIGEMVRADIFTDNESKNYVVPIYATDIFANKPLPDKYVPDNRLLPYEQWPGVFDKGLKFKFSLFKDDLISINDKKFKDKKFYVSFFESTTTNVNVKNIDGSIFPDKKNAIDPKTKKITYRPKRGKCILKKYSVDMLGNFKEVVQEKRQCNRFERRL

SEQ ID NO: 9139 - protein, 1106 aa, unidentified
  REGION 1..1106: note = Description of Unknown:uncultivated organism sequence
MGEIMNKEKVVLGLDIGVGSIGWGLVKITEEEYCDEKDDGTIDKKHRITDGTIIDTGVRAFQIPQDRQKKSLALQRGTARRSRRTTRRKAQRLKLLIKLAKEFNLIDNNFYRDEILKPKKGDKECDWDIWFIRKKALEEELSDAELFRVLYHIAKHRGFYFHTKSEEIQEEDKKSETGEVKKGLVRIRKKLEDGGWETVGQMFCEEFKQTNKENKRKRNAQDKYGNSIHRSLLKEEIEKIFEKQQKLGNNKTKEELKKRYIDEILMYEEGIDENKLRKMMSHCEFTGDLCAPKESYTAERFILFNRLNTLELVDTQDKDRHLLLDDDKQRKKIEALAYKNSKVTFAQIRTELELQDNLHIRFNLCSYSEKTPEYNKKLVCNIKDGRPDFEEKHKVSIVDIYTGEVKVLDAEIKNIFNRKTLMPNSKKIYVYYSDIRKQLKLSSDFRFKDLSGYTKSAVEFGSEAKYVKQFENDTFIELKGYHKIKKAIEDKCGKEKWEHISSNITKLDTIAESLTYCKSDETRTEYLHQHNIIDKEIIDVVLKINMKQVASYSREALEKLLENMEKGDLFQEAKEKANFPKSEYEKRAILKPYSGFFENNPVVARVISQARKLVNALVRKYQKQYLINQIHIEVATELANSEKRKNQIAQGQKRYKDDKEAAEERCREFNLDPEEGQNLLMFRLAEQQLNKCPYTGKTITFYPTAASNEVYIKDCEIDHIIPMSRSFNDSLNNKVLCSPEANQNKTNRIPFEWFEETYGKNSQRWAEFENTVKKMYEMPYPKRKNLLRKSWTDKDKEKFLSRNLNDTRYAARHIADYLRKYFDFSKSKRDEIKEVNRIQLRSGGVTAFLRHMWGLNKNREENDLHHAIDALVVACSTYGHVYLVSNLAKEIERKGKNWYKHFGRDKFKPWGNIREDVQAAVDKVFVSRMPRHTVTAAGHEETIISKEKISKNRTIKIRGGYAEMGDMVRADVFVDNVGKNYVVPIYSVDIFSNKPLPDKYLHKNDAPHDQWPSVKESKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 9140 - protein, 566 aa, unidentified
  REGION 1..566: note = Description of Unknown:uncultivated organism sequence
MGEIMNKEKVVLGLDIGVGSIGWGLVKITEEEYCDEKDDGTIDKKHRITDGTIIDTGVRAFQIPQDRQKKSLALQRGTARRSRRTTRRKAQRLKLLIKLAKEFNLIDNNFYRDEILKPKKGDKECDWDIWFIRKKALEEELSDAELFRVLYHIAKHRGFYFHTKSEEIQEEDKKSETGEVKKGLVRIRKKLEDGGWETVGQMFCEEFKQTNKENKRKRNAQDKYGNSIHRSLLKEEIEKIFEKQQKLGNNKTKEELKKRYIDEILMYEEGIDENKLRKMMSHCEFTGDLCAPKESYTAERFILFNRLNTLELVDTQDKDRHLLLDDDKQRKKIEALAYKNSKVTFAQIRTELELQDNLHIRFNLCSYSEKTPEYNKKLVCNIKDGRPDFEEKHKVSIVDIYTGEVKVLDAEIKNIFNRKTLMPNSKKIYVYYSDIRKQLKLSSDFRFKDLSGYTKSAVEFGSEAKYVKQFENDTFIELKGYHKIKKAIEDKCGKEKWEHISSNITKLDTIAESLTYCKSDETRTEYLHQHNIIDKEIIDAVLKINMKQVASYSREALEKLLEKMEK

SEQ ID NO: 9141 - protein, 538 aa, unidentified
  REGION 1..538: note = Description of Unknown:uncultivated organism sequence
MFQEAKEKANFPKSEYEKRAILKPYSGFFENNPVVARVISQARKLVNALVRKYQKQYLINQIHIEVATELANSEKRKNQIAQGQKRYKDDKEAAEERCREFNLDPEEGQNLLMFRLAEQQLNKCPYTGKTITFYPTAASNEVYIKDCEIDHIIPMSRSFNDSLNNKVLCSPEANQNKTNRIPFEWFEETYGKNSQRWAEFENTVKKMYEMPYPKRKNLLRKSWTDKDKEKFLSRNLNDTRYAARHIADYLRKYFDFSKSKRDEIKEVNRIQLRSGGVTAFLRHMWGLNKNREENDLHHAIDALVVACSTYGHVYLVSNLAKEIERKGKNWYKHFGRDKFKPWGNIREDVQAAVDKVFVSRMPRHTVTAAGHEETIISKEKISKNRTIKIRGGYAEMGDMVRADVFVDNVGKNYVVPIYSVDIFSNKPLPDKYLHKNDAPYDQWPSVKESKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 9142 - protein, 1111 aa, unidentified
  REGION 1..1111: note = Description of Unknown:uncultivated organism sequence
MNKERIVLGLDIGVGSIGWGLVQIREEEYCDEREDGTIDKKYRITDGKIIDMGVRTFQIPQDRQKKSLALQRGTASRSRKTTRRKAQRLQKLIRLAKEFNLIDNNFNRDEILKPQKGDKEAKWDIWFIRKEALERQLTNTEFFRVLYHIAKHRGFFFHTKAEEIQKEDSKSETGEVKKGLARIRKKLEDGGWETIGQMFCDEFKQTNKKYKRKRNKQDKYENSIHRSLLKEEIEKIFEEQQKLGNSRAKDELKQRYIDDILMKEEGIDDERLQKMMSKCEFIPGKLCAPKESYTAERRSFFDRLNTLELVDTQNKDKHLKLDDKQRDKIEALAYKNSKVTFAQIRKELDLENDLDKQLNLCSYKGKDPEYNKKIKCEIKNGRLKFDEKHKVPIVDINTGEVKVIEKEIKKIFNSKKLWPNSKNIYVYYSDIRKQLNLSGDFRFADLKGYTKSTAELGSESKYIKQFEDDTFIELKGYHKIRKAVENCDKNKWYELAGDTNKLDIIAEALVYHKSDETRTDYLKENGIIDEDIINAVLPINMKQVANHSKEALKKLLEYMETGDLFHEAKEKAGFGGIEYEKQAILKPYGGFFENNPVVARVISQTRKLVNALVRKYQKQFPIDQIHIEVATELASSEKRKNQIRQGQNRYREDKKAAAERCREWKLDPEEGQNLLMFRLAEQQNNKCPYTGKAITFYPTGADNEVYIKDCEIDHIIPMSRSFNDSLNNKVLCSPEANQNKRDRIPFEWFEDNYGKDSLQWMEFENRAIKMYGMPYPKRKNLNRKSWTEKDKEKFLSRNLNDTRYATRHIADYLRKYFDFSKSQRDDIKDVSRIQLRSGGVTAFLRHMWGLNKNRGENDLHHAIDALVVACSTYGHVYLVSNLAKQIERKGKNWYKHFGRDKFKPWDNIRGDIQEAVDKIFVSRMPRHTVTAAAHKETILRKAEATKKRVIEINRGYAEMGDMVRADIFVDEAGENYVVPIYSTDIFTNKPLPDKYVPHDRTIPYEQWPSIFDNDLKFKFSLFKDDLISINDKMYYVSFFEATTVNVNVKNIDGSVFPNKKNAKDPYTKKIGYRPKSRTKKCVLRKFSVDILGNYKEVKQEKRLGNRFENRN

SEQ ID NO: 9143 - protein, 1153 aa, unidentified
  REGION 1..1153: note = Description of Unknown:uncultivated organism sequence
MNKERIILGLDIGVGSVGWGLVKLTEEKYYDERTDGTSQERYRITDGKIIDAGIRVFQLPQDKEGKSLAAKRGLARRSRWTIRRKAKRLKKLINLAREFDLIGNNFNYDEVLKPKKRNNKDEKWDIWRIRKEALERKLTDTEFFRVLYHIAKHRGAYFHTKAEFLPEEDEKELKKNKTKEKEGNKKENEKEKVKNGLRKIKKMLRDRKYKTIGVLFYETFKQANSKGNNRKRNAPDKYEHSIHRELLCDEIVEIFKEQQKYGNTKAKEELRLQYIDNVLMYEEPIDEEKLRKMMGKCEFVPGADLAPKESYTAEKFSLFNRLNTLAMVDGHNKNNLQTLDAPQRDKIIALAYENAGGVTFTQIRTALELEDKLHITFNLCYYAEKNPEYNKKLKCEIKNGQLQFEEKHSLPIVNIDTGEVETLDKEIKDIFIKKFNPKYKKIYLYYSDIRKQLNLSDNFRFADLKGYTNSIAELKRENEEKNKNKKNKKPFNGEVEYIKQFENDTFIELKGYHKIKNAIEKNCSEEKWQQIRENTVKLDTIAEALTYCKSDETRANYLREHNINDKEIINAVLTINMKQLARYSIVALSNLLKYMESGALHNDAKEKCGYGKIDHKKQTILEPYKGFFEKNPVVARVISQTRKMTNAIVRKYNDKYPIDQIHIEVATELANSEKRKNEISQGQRRYKEAKEAAEERCKEYGLDPEEGQNLLMFRLAEQQNYFCTYSSKKITLHSTGAVNEVYIKDCEIDHIIPMSRSFNDSLNNKVLCAPEANQNKRDRIPFEWFEETYGKDSQQWRDFENTIKKMYGVPYPKRKNLLRKIWTEKDKEKFLSRNLNDTRYAARHITDYLREYFDFSISERDDIKEVSRVKVRSGGVTAFLRYMWGLHKDREANDLHHAIDALVVACSSDGHVYLVSNLSKEIEQKGKNWYKHFDFIRNKFKPWATVREDIQSKANNVFISRMQRHKVTAAAHEDTVRSLTEVSENKRIIKVNKGYAKIGEMVRADIFTDNESKNYVVPIYATDIFANKPLPDKYVPDNRLLPYEQWPGVFDKGLKFKFSLFKDDLISINDKKFKDKKFYVSFFESTTTNVNVKNIDGSIFPDKKNAIDPKTKKITYRPKRGKCILKKYSVDMLGNFKEVVQEKRQCNRFERRL

SEQ ID NO: 9144 - protein, 1106 aa, unidentified
  REGION 1..1106: note = Description of Unknown:uncultivated organism sequence
MGEIMNKEKVVLGLDIGVGSIGWGLVKITEEEYCDEKDDGTIDKKHRITDGTIIDTGVRAFQIPQDRQKKSLALQRGTARRSRRTTRRKAQRLKLLIKLAKEFNLIDNNFYRDEILKPKKGDKECDWDIWFIRKKALEEELSDAELFRVLYHIAKHRGFYFHTKSEEIQEEDKKSETGEVKKGLVRIRKKLEDGGWETVGQMFCEEFKQTNKENKRKRNAQDKYGNSIHRSLLKEEIEKIFEKQQKLGNNKTKEELKKRYIDEILMYEEGIDENKLRKMMSHCEFTGDLCAPKESYTAERFILFNRLNTLELVDTQDKDRHLLLDDDKQRKKIEALAYKNSKVTFAQIRTELELQDNLHIRFNLCSYSEKTPEYNKKLVCNIKDGRPDFEEKHKVSIVDIYTGEVKVLDAEIKNIFNRKTLMPNSKKIYVYYSDIRKQLKLSSDFRFKDLSGYTKSAVEFGSEAKYVKQFENDTFIELKGYHKIKKAIEDKCGKEKWEHISSNITKLDTIAESLTYCKSDETRTEYLHQHNIIDKEIIDAVLKINMKQVASYSREALEKLLENMEKGDLFQEAKEKANFPKSEYEKRAILKPYSGFFENNPVVARVISQARKLVNALVRKYQKQYLINQIHIEVATELANSEKRKNQIAQGQKRYKDDKEAAEERCREFNLDPEEGQNLLMFRLAEQQLNKCPYTGKTITFYPTAASNEVYIKDCEIDHIIPMSRSFNDSLNNKVLCSPEANQNKTNRIPFEWFEETYGKNSQRWAEFENTVKKMYEMPYPKRKNLLRKSWTDKDKEKFLSRNLNDTRYAARHIADYLRKYFDFSKSKRDEIKEVNRIQLRSGGVTAFLRHMWGLNKNREENDLHHSTDALVVACSTYGHVYLVSNLAKEIERKGKNWYKHFGRNKFKPWGNIREDVQAAVDKVFVSRMPRHTVTAAGHEETIISKEKISKNRTIKIRGGYAEMGDMVRADVFVDNVGKNYVVPIYSVDIFSNKPLPDKYLHKNDAPYDQWPSVKEGKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 9145 - protein, 1153 aa, unidentified
  REGION 1..1153: note = Description of Unknown:uncultivated organism sequence
MNKERIILGLDIGVGSVGWGLVKLTEEKYYDERTDGTSQERYRITDGKIIDAGIRVFQLPQDKEGKSLAAKRGLARRSRWTIRRKAKRLKKLLNLAREFDLIGNNFNYDEVLKPKKRNNKDEKWDIWRIRKEALERKLTDTEFFRVLYHIAKHRGAYFHTKAEFLPEEDEKELKKNKTKEKEGNKKENEKEKVKNGLRKIKKMLRDRKYKTIGVLFYETFKQANSKGNNRKRNAPDKYEHSIHRELLCDEIVEIFKEQQKYGNTKAKEELRLQYIDNVLMYEEPIDEEKLRKMMGKCEFVPGADLAPKESYTAEKFSLFNRLNTLAMVDGHNKNNLQTLDAPQRDKIIALAYENAGGVTFTQIRTALELEDKLHITFNLCYYAEKNPEYNKKLKCEIKNGQLQFEEKHSLPIVNIDTGEVETLDKEIKDIFIKKFNPKYKKIYLYYSDIRKQLNLSDNFRFADLKGYTNSIAELKRENEEKNKNKKNKKPFNGEVEYIKQFENDTFIELKGYHKIKNAIEKNCSEEKWQQIRENTVKLDTIAEALTYCKSDETRANYLREHNINDKEIINAVLTINMKQLARYSIVALSNLLKYMESGALHNDAKEKCGYGKIDHKKQTILEPYKGFFEKNPVVARVISQTRKMTNAIVRKYNDKYPIDQIHIEVATELANSEKRKNEISQGQRRYKEAKEAAEERCKEYGLDPEEGQNLLMFRLAEQQNYFCTYSSKKITLHSTGAVNEVYIKDCEIDHIIPMSRSFNDSLNNKVLCAPEANQNKRDRIPFEWFEETYGKDSQQWRDFENTIKKMYGVPYPKRKNLLRKIWTEKDKEKFLSRNLNDTRYAARHITDYLREYFDFSISERDDIKEVSRVKVRSGGVTAFLRYMWGLHKDREANDLHHAIDALVVACSSDGHVYLVSNLSKEIEQKGKNWYKHFDFIRNKFKPWATVREDIQSKANNVFISRMQRHKVTAAAHEDTVRSLTEVSENKRIIKVNKGYAKIGEMVRADIFTDNESKNYVVPIYATDIFANKPLPDKYVPDNRLLPYEQWPGVFDKGLKFKFSLFKDDLISINDKKFKDKKFYVSFFESTTTNVNVKNIDGSIFPDKKNAIDPKTKKITYRPKRGKCILKKYSVDMLGNFKEVVQEKRQCNRFERRL

SEQ ID NO: 9146 - protein, 1122 aa, unidentified
  REGION 1..1122: note = Description of Unknown:uncultivated organism sequence
MDKEKVVLGLDIGVGSIGWGLVKIREEEYCDEKADGTIDNKHRIISGEIIDTGVRAFQVPQDRQRKSLALQRGTDRRSRKTTRRKVRRLKRLIKLAKEFNLINNNFDRDEFLKPKKGDKEHGWDIWFIRKKALEKKLTDIELFRVLYHIAKHRGFHFHTKAEFLPEEDEKKLKKDKKQKKEQSEEEKEKEKVKKGLRIIQKSLKDSKYKTIGALFYETFKNERKRNAPDKYEHSIRRELLRDEIIEIFKEQQKFGNTKAKPELAQRYINEILMKEEGIDEEKFQKMMSRCEFTGGMCAPKECYTAERFTLFNRLNTLELVDTQNKEKHLMLDDKQREKIEALVYKNKKVTFNQIRTELGLQDNLHVRFNLCSYREKNPEYNKKLVCTVKDGRLEFEEKHKVPIVDINTGEVNVLDKEIKRIFKSKKLWPNSTKLHIYYSDIRKQLNRSGDFRFADLKGYTKSAGELGSEAKYVKQFEDDAFVELKGYHKIKNTIEKNCGKDKWAVLSSDTNNLDIISEALVYHKSDETRAKYLKEKGIVDEDIINAMLKINMKQLANHSKEALKKLLQYMGRGDLFNEAKKKCGYGKIDCEKQRILEPYSGFFENNPVVARVISQTRKMINAIVRKYQNQYPIDQINIEVATELASSKKRKNDIAQGQRRYREAKEAAEERCRENGLDPEEDQNLLMFRLAEQQNYFCPYTGTKITLYTTGAVNEVYIKDCEIDHVIPMSRSFNDSLNNKVLCIQKANQDKRDRIPFEWFEEIYGKDSQQWMEFENKVKKMYSVPYSKRINLLRKRWTDKDKEKFLSRNLNDTRYATRHIADYLRKYFDFSKSQRDDIKDISRIQLRSGGITAFLRHMWGLNKNRGENDLHHATDALVTACSTYGHVYLVSNLSRQMERKGQNWYKHFGREKFKPWDNIREDIQKDVENVFVSRMPRHTVTGAAHEETIISGEERDKNRTLEVRGGFAKMGNMVRADVFVDEEGRNYVVPIYTVDIFSKKPLPDKYVPDDYSLSYEKWPSIKDDNLKFKFSIFKDDLISINGTMYYVSFFEASTVNVNIKNVDRSIFPDKKDAKDPYTKKICYRPKTRGKKCLLKKYSVDMLGNYKEIRQETRLGNRFKGWV

SEQ ID NO: 9147 - protein, 1106 aa, unidentified
  REGION 1..1106: note = Description of Unknown:uncultivated organism sequence
MGEIMNKEKVVLGLDIGVGSIGWGLVKITEEEYCDEKDDGTIDKKHRITDGTIIDTGVRAFQIPQDRQKKSLALQRGTARRSRRTTRRKAQRLKLLIKLAKEFNLIDNNFYRDEILKPKKGDKECDWDIWFIRKKALEEELSDAELFRVLYHIAKHRGFYFHTKSEEIQEEDKKSETGEVKKGLVRIRKKLEDGGWETVGQMFCEEFKQTNKENKRKRNAQDKYGNSIHRSLLKEEIEKIFEKQQKLGNNKTKEELKKRYIDEILMYEEGIDENKLRKMMSHCEFTGDLCAPKESYTAERFILFNRLNTLELVDTQDKDRHLLLDDDKQRKKIEALAYKNSKVTFAQIRTELELQDNLHIRFNLCSYSEKTPEYNKKLVCNIKDGRPDFEEKHKVSIVDIYTGEVKVLDAEIKNIFNRKTLMPNSKKIYVYYSDIRKQLKLSSDFRFKDLSGYTKSAVEFGSEAKYVKQFENDTFIELKGYHKIKKAIEDKCGKEKWEHISSNITKLDTIAESLTYCKSDETRTEYLHQHNIIDKEIIDAVLKINMKQVASYSREALEKLLENMEKGDLFQEAKEKANFPKSEYEKRAILKPYSGFFENNPVVARVISQARKLVNALVRKYQKQYLINQIHIEVATELANSEKRKNQIAQGQKRYKDDKEAAEERCREFNLDPEEGQNLLMFRLAEQQLNKCPYTGKTITFYPTAASNEVYIKDCEIDHIIPMSRSFNDSLNNKVLCSPEANQNKTNRIPFEWFEETYGKNSQRWAEFENTVKKMYEMPYPKRKNLLRKSWTDKDKEKFLSRNLNDTRYAARHIADYLRKYFDFSKSKRDEIKEVNRIQLRSGGVTAFLRHMWGLNKNREENDLHHSTDALVVACSTYGHVYLVSNLAKEIERKGKNWYKHFGRDKFKPWGNIREDVQAAVDKVFVSRMPRHTVTAAAHEETIISKEKISKNRTIKIRGGYAEMGDMVRADVFVDKDGKNYVVPIYSVDIFSNKPLPDKYLHKNDAPYDQWPSVKEGKLKFKFSLFKDDLISINGQMYYVDYIRATRSKISVKKTDGSFIDNIKEEKTKEVGYKNMELKKYSVDMLGNYKEVKQEKRLGNRFKSGV

SEQ ID NO: 9148 - protein, 1106 aa, unidentified
  REGION 1..1106: note = Description of Unknown:uncultivated organism sequence
MGEIMNKEKVVLGLDIGVGSIGWGLVKITEEEYCDEKDDGTIDKKHRITDGTIIDTGVRAFQIPQDRQKKSLALQRGTARRSRRTTRRKAQRLKLLIKLAKEFNLIDNNFYRDEILKPKKGDKECDWDIWFIRKKALEEELSDAELFRVLYHIAKHRGFYFHTKSEEIQEEDKKSETGEVKKGLVRIRKKLEDGGWETVGQMFCEEFKQTNKENKRKRNAQDKYGNSIHRSLLKEEIEKIFEKQQKLGNNKTKEELKKRYIDEILMYEEGIDENKLRKMMSHCEFTGDLCAPKESYTAERFILFNRLNTLELVDTQDKDRHLLLDDDKQRKKIEALAYKNSKVTFAQIRTELELQDNLHIRFNLCSYSEKTPEYNKKLVCNIKDGRPDFEEKHKVSIVDIYTGEVKVLDAEIKNIFNRKTLMPNSKKIYVYYSDIRKQLKLSSDFRFKDLSGYTKSAVEFGSEAKYVKQFENDTFIELKGYHKIKKAIEDKCGKEKWEHISSNITKLDTIAESLTYCKSDETRTEYLHQHNIIDKEIIDAVLKINMKQVASYSREALEKLLENMEKGDLFQEAKEKANFPKSEYEKRAILKPYSGFFENNPVVARVISQARKLVNALVRKYQKQYLINQIHIEVATELANSEKRKNQIAQGQKRYKDDKEAAEERCREFNLDPEEGQNLLMFRLAEQQLNKCPYTGKTITFYPTAASNEVYIKDCEIDHIIPMSRSFNDSLNNKVLCSPEANQNKTNRIPFEWFEETYGKNSQRWAEFENTVKKMYEMPYPKRKNLLRKSWTDKDKEKFLSRNLNDTRYAARHIADYLRKYFDFSKSKRDEIKEVNRIQLRSGGVTAFLRHMWGLNKNREENDLHHAIDALVVACSTYGHVYLVSNLAKEIERKGKNWYKHFGRDKFKPWGNIREDVQAAVDKVFVSRMPRHTVTAAGHEETIISKEKISKNRTIKIRGGYAEMGDMVRADVFVDNVGKNYVVPIYSVDIFSNKPLPDKYLHKNDAPYDQWPSVKEGKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 9149 - protein, 1110 aa, unidentified
  REGION 1..1110: note = Description of Unknown:uncultivated organism sequence
MRQSRIVLGLDIGVSSIGWGLVQLEEEPYPYERDDGTVEQKQRIVNGRIIGTGVRCFQVPQDREKKSLAKKRGIARRNRWRVRRRAQRLKRLVELGKEFGLIGEDFRHEKYLKPGKGDGEGNWDIWTIRKEGLERKLSDVELFRVLYHIAKHRGFYFHTKAEELQEEDAKSKQGQVKRGLASVEKKLRGGGWETVGQMFYATLKQAEGKRKRNRKDSYENLMHRRLLEKEIVTVFERQRKFLNGKAGEELQKRYIEEILLSEKGPDEAKLQKMMGVCDFTGKRCAPKAGYTAERFMLFNRLNSMSVGNGERCGGGERLTDQQRRTIEELAYNNEKVTFWQVRNALGLDSKLDARFNLCSYREHDPEYRKKLECAVKGGKLEFDEKHRVPVVNIRTGEVHELDGEIREVFESKKLWPNAKKIHVFYSDIRKQLSLSEDVRFLKLSGYTKSAEELGSEAKYVKQFENAIFVELRGYHKLRKAIEGQCGQAAWQELRQDTDRLDAIAEALTYCKSDVTRRAYLKERGIQDEKVIEAILRVNMSQVANHSQEAMRRLLQHMENGALFNEAKEECGYGRVEYDKQRLLQPYSGVFENNPVVARVISQARKVVNAIVRKYGEEYPIDQIHVEVATDLASSKKRREEIAWGQQRYREEKERAKERCREFGIDPDEGQNLLKFRLAEEQNCRCVYSGARITLYPGGGKDEVYVLDCEIDHIIPMSRSFNDSLNNKVVCTPQANQNKRDRIPYEWFEERYGKDSEQWSAFERTVKQLYGMPYPKRRNLLRRSWTEEDKERFISRDLNDTRYAARHLAEYMRKYFDFSRSKRSDIKEVKRIQVRSGGVTAFLRHMWGLNKDREANHLHHAVDALVVACATDGHVYLVSNLSKEVERKGENWYRAFGRDKFKPWGLVREDIMEAVGRIFVSRMPRRTVTSAAHEESIKSMKKERPKKRVVEVGGGYAEIGDIVRADVFVDEKGHNYMVPIYAVDMACSKPLPDKYLHKNDAPYAEWPSAKDDGLTFRFSLYKDELVSLDGKMYYVAYVRGRRAVIAVKNVDGSPFPNGRTEVEMAYRRAKLAKYCVDVLGSLREVHERRRVGNQFEESKRGRKGQKNEGLG

SEQ ID NO: 9150 - protein, 1031 aa, unidentified
  REGION 1..1031: note = Description of Unknown:uncultivated organism sequence
MEKKRYRLGIDLGTASIGTALVELDGPAEHPHPINILHMGVRIFDDGRDPKTKVPLGVARREAKQARKMFDRYLRRRKRLIDALIEFKIWPTDEPQRKALCLLNPYDIRTRALDEKVSLHELGRAIFHLNQRRGFKSNRKTDGGEDGKIRQAVAKLEELFQSEGCRTLGEFYHNRLNKGQSVRARLEGAGAKASYPFYPSRQMIECEFDKIWEKQSEFYPNILTENARNKIRSTLLYQRPLKPAIPGKCFLEPSENRAPIASPYFQRFRILQTINELRIIDRRGDQRPLTLEERNILLENLSQKKDLNFSAAKKLLSLSNYDRFSIQDERRDKFQGDQIAVLLGNKKYFGKNWYKLPLENQNEIVKALVNEQDTEKLIETLCVFGLSKEAAAQLSEETLPTGYGRLSLVALKKIIPFLEESVITYSEAAAKAGYNHSDNYTGEIFHYLPYYGKVLENRVMRGSGNEADNDEDRYGKVGNPTVHIALNQLRRVVNCVIKHFGAPEQIVIEVARDLKMTQDEIKNYKKKQADNEKRNERIDNELKKLGQSINRENRERYKLWEELADNPMDRCCPYTGQHIGIEKLFTEEVEIEHILPFAQTYEDSLANKTLSMRFANRLKQNRSPYEAFAEHSYKGILSYQEMLDKLPKDKAWENKRWRFEKGAMEKYNANGDFQARQLTDTAYASRLALEYLKFVCPKDSVWAIPGKLTSMLRRQWGLNSILGRELPDGSFEKSRDHHGHHAIDGLVVAMTDRALLKKMSDATQINWEHQERVLSHIDPPIIDIYDQAKERLSHLVVSHRKDHGLGGELHNKTAYGIIGEFKEGTVSTVKHKVPITSISSTNINQIQNDFIRNGIQNLIADSSSKQSLESAINEFSNKTGIRRVTLVEKLSVVPIKDKSGRIYKAFKPDGNYCYDIWANGDKWEGKIVSRFEANTQGTKMTQNILMRLIVGDTICREINGQKEFLRLVKMSLGRITFAPIFEAGALKTRDSDPKDPFKYITMSPNLLKQNKVRLIHVDECGFVYDPGFKEK

SEQ ID NO: 9151 - protein, 1178 aa, unidentified
  REGION 1..1178: note = Description of Unknown:uncultivated organism sequence
MSSALTSSNSSESQKNIAVTSPGPWRLGLDIGVGSIGWAVYRVRPNEPEQQFAGGDLSLFASLDEPAIVNGTQWYTPIALVDGGVTIFDSGVDQHQKTASAQRRLFRSQRTHIKNTRDRKRALLQRLVSLGFLSSDPIIRKRHRDEKRFVGLFDEFAIPASWAWRWEGIHGTLTPHELGCVLMALCAARGQTFSIDSKSANRLEDASALERAIKSAGCITFGEYAAVQLAQNRQQIVRARRGVPNYCSRTMVIHEFDTICNRQQAIIPVAIAKELRALIFDQEFTSVLPPGRCPIFPHEDRFPIAHPMTQRLKILQMLRNIRVESSCGPDGLFAMEDRHLTPEEEQQAMLFLRDKKDVSPMRLFFAIGLKGQRSNYHRAHKNRKDDDVDIVGDATGHALSHSKAFGSAWFDFDEQQRQAIVEEMLQYRENDPATGRRRCPDYVDLARRWGITEENARNAFDNLPRGRSAYGRTATYAIAQRLEAYPQEGLHEARQALYPQHDEKIPVRGRLPYYGQILPDAVFDGDPDAQRAPKEPLAAYEERRYGRVRNPQVHVAIQQIRGLVNAIIEAYGSPAEIVVELARDLCESPKQRKERERAMRDRKKRREAVVDILKRDGIKPTQYNIEKYMLWEDLGPLPEARLDIYSGTPIPHHAMLYSGDIQVDHIIPRALCGDDSLANKIVTFTQMNQDKKDRLPFQAFHGQQYGEIKKRAQDVYGGDRKDKARMRKYRRFLESAEKEFVTDADFAGRELAATAYAAKVVRRYLTAVLDGAHVHAAHGRLTGRLRKAWDLSTLLPRHEEAIAIAQRLHLEGHDEKINPELKRFDHRHHLIDAAIIGMIDPTTIRKFFQMSERDLLKKDERKQDFPFRDSLESIIHATIVRHRPYHKQGYTYAGAGVKATRYRLAKTTEKRQVILRQDIFSLGIANGIWQLGKTDDDFSENILRAIEQSGAFSVEQIAIAKTTFAQQYFKDLMSRFHWDAYITKEQAKQAFIKHRTLVWKRLCDEFTTAIGGQSTYSNMRTMNTLIQTSSGAMMEPGGYAFADIYIQKHANGKTSYRMAPVYLHEAANRTRVATQPAEGEHLLCRIHHGDTLRLYLDGVPSYVVVKSFNGQKKSISIAMHHNAARTSGRMLSANIPIEGPSGSCGSRTVAWVFGVAKARIVRIGPLGRYGTINQRSKI

SEQ ID NO: 9152 - protein, 1081 aa, unidentified
  REGION 1..1081: note = Description of Unknown:uncultivated organism sequence
MSKNENRGPWRLGLDLGTNSIGIAALSLRKLPGKDEDEKQEYRVLGLMMLGARIFSDGRNPKDKQSLAAMRRVPRGMRRNRDRTLNRNARFLKELQGFGLLPAASDPPSAAELATRRELAALDPYILRARGLDEELPLHHLGRALFHLKRRGFQSNRKTDSGDQESGKIRDAANRTREKMEGEGGRTLGEWLGRQRMETLAENEALAKGKRKPLPQARTRLHGAGAKAYYDFYPTRAMILDEFDRLWESQRRWHPAALTDEAYQTLRKTLAFQYPLKTPPVGKCTLDPSQERAPRALPSVQRLRIYQELNHLQVMDCPGEPWRAIEKKERDLLAKKALGQEKLTFDGMRKWLKLSAHARFNLETDKRKYLDGDKTAAMLASPKRWGKGWRDLPFDTQEEIVTKLLETEKEEELLPWLMAEHGLSREDALAVSRTTLPAGHGAFCAEVSRGLLAELEQDVITYDEAVKRAGYASHSQLDDGVRVDRLPYYGKILARHVAFGSGEPGDPEEKRYGKLANPTVHVALNQLRRVVNDLIARFGPPTQIVVELARDLPLSAEGKRALEKTQKDNQAANDERRKILREHKQPDNYQNRLRLRLWEELNPDDPLDRRCVFSGEQISITRLFSDEVEIEHLLPFSQTLDDSPANKTISTRRANREKGNRSPYEAFSHSPLGFDWEEIAQRAANLPPNKSWRFSPDAMERYQDEERDFLDRQLTDTQYIARLAGTYLAATGADVWVIPGRLTADLRWALGLDNLLAAPGEGVDAKKNRADHRHHVIDALVVALTERGRLQKVATLAGQRREQGHTRLLQNPEEPWPDFRQEVADCVEKIVVSHKPDHGVQGALHNDTAYGLLDEAPDAKGVRTVVHRVPLESFKKRANIRNIRDDVLREYFIANTEYVPDKEIGKTLVALGERLHPPVRRVRICERLNVIPISDAQGQPFKAYKGDANYCYDIFAGAPGKSGATKWTGRVVSRFDANQQGFEPQARVSTGGEPLIMRLRIDDMLELDDGGGRRIVRVVQLSEGQITLAGDHEAGDLKKRDKDKEDPFKYLRLVPSTLQARNARMVHVSPSGVIRHKGNLS

SEQ ID NO: 9153 - protein, 1079 aa, unidentified
  REGION 1..1079: note = Description of Unknown:uncultivated organism sequence
MREKENRGKWRLGIDLGTNSIGIAVLSLSEPTEADGKHTVSGLMDLGVRIFSDGRNPKDKQSLAAMRRAPRGMRRNRDRKLNRNARFLRELWAFGLLPTASDPPTKAELAKRQELEALDPYILRARGLDEELPLHHLGRALFHLKRRGFKSNRKTDSGDQESGKIRGATNRTKELLEKEDCRTLGEWLGRQRIQTLEKNAAASKGKRQPLPQARTRLHGTGTKAYYDFYPTREMILDEFDRLWESQQRWHPEALTDDAFRTLCETLAFQYPLRPPPVGKCTLEPAQERAPRALPSVQRLRIYQELNHLVVQLPGKSSRPINKKERDLLAEKALSQNKLEFDKMRRWLKLPLDARFNLESKKRKHLDGDLTAAELASAKCWGKDWRDLDLDIQEAIVTRLLEQENEDQLVSWLMEEHGLSRERAQAVSLASLPAGHGAFCAEVSRKLLEQLERDVVTYNEAVKLAGYESHSQLDNDAVFDRLPYYGKVLERHVAFGSGEPDDPEEKRYGKVANPTVHVALNQLRRVVNDLMGRFGAPAEIVVELARDLPLSAQEKWKLERTQKDNQAANDKRRKILEEYERTDDYENRLRLRLWEELSQDPLDRRCVFTGEQISLANLFSDKVEIEHLLPFSRTLDDSPANKTVSMRWANRKKANRSPFEAFSDSQPGLDWEEITARAANLPLNKSWRFAPDAMARYENQERDFLARQLTDTQYIARLATTYLKATGAYVRVIPGRLTANLRRVLSLNTLLTEPGEGGTKKNRLDHRHHAIDALVVALTERSLLNEVARNARRRKEEDVPRLLQNPGDPWPGFRRDVVTCVENIVVSHKPDHGVQGALHNDTAYGLLDEEPDTKGIRTVVHRVPLDSFKRRADIENIRDDKLREYFLANTEYVPDKEIGKTLVELGERQHPPVRRVRICERLNVIPIRNAQGQPFKAYKGDANYCYDIFTGTPKKSTEGKSTGNKWAGRVISRFAANQPGFQPQARVSTGGEPLIMRLRVNDMLELDHGNERRIMRVVKLSKGQIALARDREAGNLKARDTDKADPFKYLTLSPTGLGTRNARMVHVSPSGVIRHKGNLS

SEQ ID NO: 9154 - protein, 1078 aa, unidentified
  REGION 1..1078: note = Description of Unknown:uncultivated organism sequence
MREKENRGKWRLGIDLGTNSIGIAALSLNEPTEAGGKHTVSGLMDMGVRIFSDGRNPKDKQSLAAMRRIPRGMRRNRDRKLNRNARFLRQLRGFGLLPTTSDPPTKEDLARRQELEALDPYILRARGLDGELHLHHLGRALFHLKRRGFKSNRKTDSGDQESGKIREATNRTKEQLEEAGCRTLGEWLGRQRIQTLEKNAAAPKGKRDPLPQARTRLHGGAKAYYDFYPTREMILDEFDRLWESQRRWHPEALTDDAFRTLRETLAFQYPLRPPPVGKCTLDSTQERAPRALPSVQRLRIYQELNHLAVQQPGESSRPIEKKERDLLAEKALSQAKLEFDKMRRWLKLPLDGRFNLESEKRKHLDGDLTAAKLASAKCWGKDWRDLNLDTQEAIVTRLLEQENEDQLVSWLMEEHGLSREKAMAVSRVQFPTGHGAFCAEVSRKLLEQLEADVVTYNEAVELAGYESHSQLDNDAVFDRLPYYGKVLERHVAFGSGEPHDPEEKRYGKVANPTVHVALNQLRRVVNDLMGRFGAPAEIVVELARDLPLSAQEKRKLERTQKDNQAANDKRREILRDYSEKDNYENRLRLRLWEELSQDPLDRRCVFTGEQISFGRLFSDEVEIEHLLPFSRTLDDSPANKTISMRWANRKKANRSPFEAFSDSQPGLDWEEITARAANLPLNKSWRFAPDAMERYENEERDFLARHLTDTQYIARLAVSYLKATGADVRVIPGRLTADLRQVLGLNTLLAESGKSGTKKNRADHRHHAIDALVVALTQRGLLQKVATRAGRAREEGRTRLLQNPGDPWPGFRNDVASCVEEIVVSHKPDHGVQGALHNDTAYGLLKEEPDTKGIRTVVHRVSLDSFKRRADIENIRDDKLREYFLANTEYVPDKEIGKTLVELGERQHPPVRRVRICERLDVIPIRDAQGQPFKAYKGDANYCYDIFTGTPKKSTEGKSTGNKWAGRVISRFAANQPGFQPQARVSTGGEPLIMRLRVNDMLELEESDDRWIMRVVKLSKGQITLARDREAGNLKARDADKADPFKYLTLSPAGLGARSARMVRVGPSGVIRHKGNLS

SEQ ID NO: 9155 - protein, 913 aa, unidentified
  REGION 1..913: note = Description of Unknown:uncultivated organism sequence
MGFKTYGQFLWYREKRRKKVRINQEVIGKGSYDFYPSRDLLRKEFDIIWQKQKEFHQEKLNDSFRESLEEELFFQRKVSTPPPGNCSYVTNEKRLPKSSRLFQEKRIYEEVNNLRFSHQGTPLPELTIGQRDELVESLMRGESLNKTDIKTIIGIKKNCKVNLEDSKARTEIAKYPFSNYELGEEWAELNAENKDFVLEILSTHFDKEEAVDKIKTVINLSDQLTKRLIQTDFPKGYGNLGKTATRKILVELKKHPTLSSRAAEDLAGLVHAQTPIGEIFRKLPYYGEVLKGYAIEPIWIFSENPSNKPPNTNFLEKKYGRAPNPVVHVALNQIRKAVNCLIDKYGLPEKIYVELARDLGKSEKTKALIEQKIASNREKREQIRRKLKENELEQTRPNELKYELWEQQKCKCVYTGDNISLIQLFSGEVEIDHILPRSKTYDDSKANMVLCKKSANAFKNNRTPYDAFSSDPNFDWDAIIRRVNDLPAGKKNRFKSDALERFENNPDYWRERFSIDNSYIAKITRQYLTCLYGKPENVIAVSSKVTSLLRKKWGLNKVLGGESSIKQRDDHRHHFIDALVVGCTTRSTIQKIQTAARHCEEKRILGIVDKIQPPFGGEREFWSHVEKVTQNVLLSRKPDNSASGQLHEDTLRGIVSGPNKEGKYLTRTKVKLGDIKSLTDLKKKKISGKLITDYGDIPLIADFTNNLNMIQNKVEGFCQKARLELETEAIQNKNQGKKVRAITETLVYKKAIDLMKKKALPCYYWDFKEQKLVNVIKQGNKFNGGYLSGRNHRMDFYQSSQGKIKWQIITMFEANDETFVPESDKAGNALLWSAHKDDILLLDDPDNLNYRVRMIVVKIKDGRMGVVKCTDARDAGTRSLYENGLKFFKEKRAQRIITNHLGEPTYFFPMLNE

SEQ ID NO: 9156 - protein, 1069 aa, unidentified
  REGION 1..1069: note = Description of Unknown:uncultivated organism sequence
MNTTPFKYNLGIDVGVASLGLAVIEIDKEENVIGVKEGFVRTWSAPVGGETRRLARSQRRMIDRKQMRLRRLAQIFLKNGIGFPHNDIPKYLLDKSPLKLRAKAVNEKIDLEELQRIILHMAKHRGSSAFDGRDNDEKDTLLTKEGIKKLEVKINEMGFKTYGQFLWYREKRFKKVRINQEVIGKGGYDFYPSRSLLREEFDIIWKKQKEWYQEKLNDSFRESLEEVLFSQRKVSIPPPGNCSYVTNEKRLPKSSRLFQEKRIYEEVNNLRFSHQGTPLPELTIGQRDKLVEYLMRGESLNKTEIKTRIGIKKNCKVNLEDSKDRTEIAKYPFSDSELGEEWAELNEENKDFVLEILSTHFDKEEAVDKIKTVINLSDQLTKRLIQTDFPKGYRNLGKTATRKIIEELKKHPTLSSRQAEDLAGLVHAQTPTGEIFRKLPYYGEVLKGYAIEPIWIFSENPSNKPPNTNFLEQKFGRAPNPVVHVALNQIRKAVNCLIDKYGLPEKIYVELARDLGKSEKTKAKIEQEIASNRKKREQIRWKLKEHEIEQTRHNELKYELWEQQKHKCVYTGDNIDLIQLSSGEVEIDHILPRSKTYDDSKANKVLCKKSANAFKNNRTPYDAFSSDPNFDWDAIIRRVNDLPPGKKNRFKSDALERFENNPDYWRERFSIDNSYIAKITRQYLTCLYGKPENVIAVSSKVTSLLRKKWGLNKVLGGESNIKQRDDHRHHFIDALVVGCTTRSTIQKIQTAARHCEEKRILGIVDKIQPPFGGEREFWSHVEKVTQNVLLSRKPDNSASGQLHEDTLRGVVSGPNEKGKYLTRTKVKLGDIKSLTDLKKKKISGKLITDYGDIPLIADFTNNLNMIQNKVEGFCQKARLELETEAIQNKNQGKKVRAITETLVYKKAIDLMKKKALPCYYWDFKEQKLVNVIKQGNKFNGGYLSGRNHRMDFYKNNKGKIKWQIITMFEANDKTFVPESDKAGNALLWSAHKDDILLMDDPDNLNYRVRMIVVKIQDGRMGVVKCTDARDAGTRSLYENRLKFFKEKRAQRIITNHLGEPTYFFPMLNE

SEQ ID NO: 9157 - protein, 1069 aa, unidentified
  REGION 1..1069: note = Description of Unknown:uncultivated organism sequence
MNTTPFKYNLGIDVGVASLGLAVIEIDKEENVIGVKEGFVRTWSAPVGGETRRLARSQRRMIDRKQMRLRRLAQIFLKNGIGFPHNDIPKYLLDKSPLKLRAKAVNEKIDLEELQRIILHMAKHRGSSAFDGRDNDEKDTLLTKEGIKKLEVKINEMGFKTYGQFLWYREKRFKKVRINQEVIGKGGYDFYPSRSLLREEFDIIWKKQKEWYQEKLNDSFRESLEEVLFSQRKVSIPPPGNCSYVTNEKRLPKSSRLFQEKRIYEEVNNLRFSHQGTPLPELTIGQRDKLVEYLMRGESLNKTEIKTRIGIKKNCKVNLEDSKDRTEIAKYPFSDSELGEEWAELNEENKDFVLEILSTHFDKEEAVDKIKTVINLSDQLTKRLIQTDFPKGYGNLGKTATRKIIEELKKHPTLSSRQAEDLAGLVHAQTPTGEIFRKLPYYGEVLKGYAIEPIWIFSENPSNKPPNTNFLEQKFGRAPNPVVHVALNQIRKAVNCLIDKYGLPEKIYVELARDLGKSEKTKAKIEQEIASNRKKREQIRWKLKEHEIEQTRHNELKYELWEQQKHKCVYTGDNIDLIQLSSGEVEIDHILPRSKTYDDSKANKVLCKKSANAFKNNRTPYDAFSSDPNFDWDAIIRRVNDLPPGKKNRFKSDALERFENNPDYWRERFSIDNSYIAKITRQYLTCLYGKPENVIAVSSKVTSLLRKKWGLNKVLGGESNIKQRDDHRHHFIDALVVGCTTRSTIQKIQTAARHCEEKRILGIVDKIQPPFGGEREFWSHVEKVTQNVLLSRKPDNSASGQLHEDTLRGVVSGPNEKGKYLTRTKVKLGDIKSLTDLKKKKISGKLITDYGDIPLIADFTNNLNMIQNKVEGFCQKARLELETEAIQNKNQGKKVRAITETLVYKKAIDLMKKKALPCYYWDFKEQKLVNVIKQGNKFNGGYLSGRNHRMDFYKNNKGKIKWQIITMFEANDKTFVPESDKAGNALLWSAHKDDILLMDDPDNLNYRVRMIVVKIQDGRMGVVKCTDARDAGTRSLYENRLKFFKEKRAQRIITNHLGEPTYFFPMLNE

SEQ ID NO: 9158 - protein, 1069 aa, unidentified
  REGION 1..1069: note = Description of Unknown:uncultivated organism sequence
MNTTPFKYNLGIDVGVASLGLAVIEIDKEENVIGVKEGFVRTWSAPVGGETRRLARSQRRMIDRKQMRLRRLAQIFLKNGIGFPHNDIPKYLLDKSPLKLRAKAVNEKIDLEELQRIILHMAKHRGSSAFDGRDNDEKDTLLTKEGIKKLEVKINEMGFKTYGQFLWYREKRRKKVRINQEVIGKGSYDFYPSRDLLRKEFDIIWQKQKEFHQEKLNDSFRESLEEELFFQRKVSTPPPGNCSYVTNEKRLPKSSRLFQEKRIYEEVNNLRFSHQGTPLPELTIGQRDELVESLMRGESLNKTDIKTIIGIKKNCKVNLEDSKARTEIAKYPFSNYELGEEWAELNAENKDFVLEILSTHFDKEEAVDKIKTVINLSDQLTKRLIQTDFPKGYGNLGKTATRKILVELKKHPTLSSRAAEDLAGLVHAQTPIGEIFRKLPYYGEVLKGYAIEPIWIFSENPSNKPPNTNFLEKKYGRAPNPVVHVALNQIRKAVNCLIDKYGLPEKIYVELARDLGKSEKTKAWIEQKIAINREKREQIRRKLKKNELEQTRPNELKYELWEQQKCKCVYTGDNISLIQLFSGEVEIDHILPRSKTYDDSKANMVLCKKSANAFKNNRTPYDAFSSDPNFDWDAIIRRVNDLPAGKKNRFKSDALERFENNPDYWRERFSIDNSYIAKITRQYLTCLYGKPENVIAVSSKVTSLLRKKWGLNKVLGGESSIKQRDDHRHHFIDALVVGCTTRSTIQKIQTAARHCEEKRILGIVDKIQPPFGGEREFWSHVEKVTQNVLLSRKPDNSASGQLHEDTLRGIVSGPNEKGKYLTRTKVKLGDIKSLTDLKKKKISGALIKGYGDNPSIADFTNNLNMIQNKVEGFCEKARLELRAEAIQNKNQGKKVRAITETLVYKKAIDLMKKKALPCYYWDFKEQKLVNVIKQGNKFNGGYLSGRNHRMDFYKNNKGKIKWQIITMFEANDETFVPESDKAGNALLWSAHKDDILLLDDPDNLNYRVRMIVVRISDGKMGVVKCTDAKDAGKRLLYERRLKFFKEKRAQRIITNHLGEPTYFFPMLNE

SEQ ID NO: 9159 - protein, 548 aa, unidentified
  REGION 1..548: note = Description of Unknown:uncultivated organism sequence
MNTTPFKYNLGIDVGVASLGLAVIEIDKEENVIGVKEGFVRTWSASVGGETRRLARSQRRMIDRKQMRLRRLAQIFLKNGIGFPHNDIPKYLLDKSPLKLRAKAVNEKIDLEELQRIILHMAKHRGSSAFDGRDNDEKDTLLTKEGIKKLEVKINEMGFKTYGQFLWYREKRGKKVRINQEVIGKGSYDFYPSRSLLREEFDIIWKKQKEWYQEKLNDSFRESLEEVLFSQRKVSTPPPGNCSYVTNEKRLPKSSRLFQKKRIYEEVNNLRFYNHNNTPLPYTVNQRDRLVETLMEGKSLNKTNIKKIIGNKANTKVNLEDSKARTEIAKYPFSDSELGKEWAELNEENKDFVLEILSTNFHKEEAEHKIKTVINLSDQLTKRLIQTNFPKGYGNLGKTATKKIIEKLREYHTLSSRQAEDLAGLVHSQTPTGELFKKLPYYGEVLKGYAIEPIWLFSENPSNKPPNTNFLEKKYGRAPNPVVHVALNQIRKTVNRLIDKYGLPEKIYIELARDLGKSEKTKALIEQKESKLGGSLRKMNLNKRDPTN

SEQ ID NO: 9160 - protein, 519 aa, unidentified
  REGION 1..519: note = Description of Unknown:uncultivated organism sequence
MKYELWEQQEYKCVYTGDNISFIQLFSGEVEIDHILPRSKTYDDSKANMVLCKKSANAFKNNRTPYDAFSSDPNFDWDAIIRRVNDLPAGSHIFTKQDRFKSDALERFENNPDHWRERFSIDTSYIARITRQYLTCLYGKPENVIAVKSRVTSLLRRKWGLNKVLGKNSNIKQRDDHRHHFIDALVVGCTTRSTIQKIQTAARHCEEKGILGIVDKIQPPFGGEREFWSHVEKVTQNVLLSRKPDNSASGQLHEDTLRGIVSGPNKEGKYLTRTKVKLSNINSLTDLKKKKISGKLITDYGDIPLIADFTNNLNMIQNKVEEFCQKARLELETEAIQNKNQGKKVRAITETLVYKKAIDLMKKKALPCYYWDFKEQKLVNVIKQGNKFNGGYFSGRNHRMDFYQSSQGKINWQIITMFEANDETFVPESDKAGNALLWSAHKDDILLLDDPDNLNYRVRMIVVKISDGKMGVVKCTDAKDAGKRSLYERRLKFFKEKRAQRIITNHLGEPTYFFPMLNE

SEQ ID NO: 9161 - protein, 776 aa, unidentified
  REGION 1..776: note = Description of Unknown:uncultivated organism sequence
MEGESLNKTKIKKTIGSKKNCKVNLEDSKARTEIAKYPFSNYELGEEWAELNAENKDFVLEILSTHFDKEEAVDKIKTVINLSDQLTKRLIQTDFPKGYGNLGKTATKKIIEELKKHPTLSSRQAEDLAGLVHAQTPTGELFRKLPYYGEVLKGYAIEPIWIFSENPSNKPPNTNFLEKKYGRAPNPVVHVALNQIRKAVNCLIDKYGLPEKIYVELARDLGKSEKTKAKIEQEIAINRKKREQIRRKLKENELEQTRPNELKYELWEQQECKCVYTGDNISFIQLFSGEVEIDHILPRSKTYDDSKANMVLCKKSANAFKNNRTPYDAFSSDPNFDWDAIIRRVNDLPAGKKNRFKSDALERFENNPDYWRERFSIDNSYIAKITRQYLTCLYGKPENVIAVSSKVTSLLRKKWGLNKVLGGESNIKQRDDHRHHFIDALVVGCTTRSTIQKIQTAARHCEEKRILGIVDKIQPPFGGEREFWSHVEKVTQNVLLSRKPDNSASGQLHEDTLRGIVSGPNEKGKYLTRTKVKLGDIKSLTELKKKKISGALIKGYGDNPSIADFTNRLNLIQNKVEEFCQKARLELETEAIQNKNQGKKVRAITETLVYKKAIDLMKKKALPCYYWDFKEQKLVNVIKQGNKFNGGYLSGRNHRMDFYQSSQGKIKWQIITMFEANDETFVPESDKAGNALLWSAHKDDILLLDDPDNLNYRVRMIVVKIKDGYMGVVKCTDASEAGNNRSLYEKGLKFFKEKRAQRIITNHLGEPTYFFPMLNE

SEQ ID NO: 9162 - protein, 1070 aa, unidentified
  REGION 1..1070: note = Description of Unknown:uncultivated organism sequence
MNTTPFKYNLGIDVGVASLGLAVIEIDKEENVIGVKEGFVRTWSAPVGGETRRLARSQRRMIDRKQMRLRRLAQIFLKNGIGFPHNDIPKYLLDKSPLKLRAKAVNEKIDLEELQRIILHMAKHRGSSAFDGRDNDEKDTLLTKEGIKKLEVKINEMGFKTYGQFLWYREKRGKKVRINQEVIGKGSYDFYPSRSLLREEFDIIWKKQKEWYQEKLNDSFRESLEEVLFSQRKVSIPPPGNCSYVTNEKRLPKSSRLFQEKRIYEEVNNLRFSHQGTPLPELTIGQRDELVETLMEGKPLKKTDIKKIIGNKANTKVNLEDSKDRTLIAKYPFSDSELGEEWAELNEENKDFVLEILSTHFDKEEAVDKIKTVINLSDQLTKRLIQTDFPKGYGNLGKTATKKIIEELKKNPTLSSRQAEDLAGLVHAQTPTGEIFRKLPYYGEVLKGYAIEPIWIFSENPSNKPPNTNFLEKKYGRAPNPVVHVALNQIRKTVNLLIDKYGLPEKIYVELARDLGKSEKTKALIEQKIASNREKREQIRRKLKENEIEQTRPNELKYELWEQQKCKCVYTGDNISLIQLFSGEVEIDHILPRSKTYDDSKANMVLCKKSANAFKNNRTPYDAFSSDPNFDWDAIIRRVNDLPAGKKNRFKSDALERFENNPDYWRERFSIDNSYIAKITRQYLTCLYGKPENVIAVSSKVTSLLRKKWGLNKVLGGESNIKQRDDHRHHFIDALVVGCTTRSTIQKIQTAARHCEEKRILGIVDKIQPPFGGEREFWSHVEKVTQNVLLSRKPDNSASGQLHEDTLRGIVSGPNEKGKYLTRTKVKLGDIKSLTELKKKKISGALIKGYGDNPSIADFTNRLNLIQNKVEEFCQKARLELETEAIQNKNQGKKVRAITETLVYKKAIDLMKKKALPCYYWDFKEQKLVNVIEQGNKFNGGYLSGRNHRMDFYQSSQGKINWQIITMFEANDETFVPESDKAGNALLWSAHKDDILLLDDPDNLNYRVRMIVVKIKDGYMGVVKCTDASEAGNNRSLYEKGLKFFKEKRAQRIITNHLGEPTYFFPMLNE

SEQ ID NO: 9163 - protein, 1069 aa, unidentified
  REGION 1..1069: note = Description of Unknown:uncultivated organism sequence
MNTTPFKYNLGIDVGVASLGLAVIEIDKEENVIGVKEGFVRTWSAPVGGETRRLARSQRRMIDRKQMRLRRLAQIFLKNGIGFPHNDIPKYLLDKSPLKLRAKAVNEKIDLEELQRIILHMAKHRGSSAFDGRDNDEKDTLLTKEGIKKLEVKINEMGFKTYGQFLWYREKRFKKVRINQEVIGKGGYDFYPSRSLLREEFDIIWKKQKEWYQEKLNDSFRESLEEVLFSQRKVSIPPPGNCSYVTNEKRLPKSSRLFQEKRIYEEVNNLRFSHQGTPLPELTIGQRDKLVEYLMRGESLNKTEIKTRIGIKKNCKVNLEDSKDRTEIAKYPFSDSELGEEWAELNEENKDFVLEILSTHFDKEEAVDKIKTVINLSDQLTKRLIQTDFPKGYRNLGKTATRKIIEELKKHPTLSSRQAEDLAGLVHAQTPTGEIFRKLPYYGEVLKGYAIEPIWIFSENPSNKPPNTNFLEQKFGRAPNPVVHVALNQIRKAVNCLIDKYGLPEKIYVELARDLGKSEKTKAKIEQEIASNRKKREQIRWKLKEHEIEQTRHNELKYELWEQQKHKCVYTGDNIDLIQLSSGEVEIDHILPRSKTYDDSKANKVLCKKSANAFKNNRTPYDAFSSDPNFDWDAIIRRVNDLPPGKKNRFKSDALERFENNPDYWRERFSIDNSYIAKITRQYLTCLYGKPENVIAVSSKVTSLLRKKWGLNKVLGGESNIKQRDDHRHHFIDALVVGCTTRSTIQKIQTAARHCEEKRILGIVDKIQPPFGGEREFWSHVEKVTQNVLLSRKPDNSASGQLHEDTLRGVVSGPNEKGKYLTRTKVKLGDIKSLTDLKKKKISGKLITDYGDIPLIADFTNNLNMIQNKVEGFCQKARLELETEAIQNKNQGKKVRAITETLVYKKAIDLMKKKALPCYYWDFKEQKLVNVIKQGNKFNGGYLSGRNHRMDFYQSSQGKINWQIITMFEANDETFVPESDKAGNALLWSAHKDDILLLDDPDNLNYRVRMIVVKISDGKMGVVKCTDAKDAGKRSLYERRLKFFKEKRAQRIITNHLGEPTYFFPMLNE

SEQ ID NO: 9164 - protein, 1064 aa, unidentified
  REGION 1..1064: note = Description of Unknown:uncultivated organism sequence
MRWRLGLDIGTNSIGWAAIELDGGEPKRGPLLGSGVRVFPDGRNPKDKQSLAAQRRGPRSMRKRRDRYLKRRSEFMDKLIEYELMPTDQATRKELEKDDPWALRVRGLDEKLTLHELGRALFHLQQRRGFKSNRKTDTGDDDEKGKIKSAAAKVRQELENRDARTLGELLARPRIEDPLAARDHPVRARLKGQGAKAFYDFYPTRDLIAEEFDALWSAQTQFHGEALSDEVRKDLRDTLLFQRPLRPQPVGKCTLDPSEDRAPRALPSQQRLRIYQEINHLLVREPGKAFRPLALEEREILAGRALKTQKLKFDTARNALKLPADARFNYENDLRRTGLDGDKTADILKSDRLWGAGWRELDFEKQEEIVERLISDLPDAEVTAWLVDSHGLTQEKAEAVANANLPAGHGRLGRTATRTVLEALVSGCAEAVDPQTGEVFERPVTYDEAVKLAGYEHHSDLDSKSEVLKRLPYYGQALERHVAFGTGEPDDPLEKRIGKIANPTVHVALNELRKLVNTLIKRFGPPAEIAVELARDLPLSAKGKSDLEREQRENQTKNDERRKLLAELGHPDNYENRLRLRLWEELNPQDPLDRRCPFTGEQIGIDRVFSDEVEIEHILPFSRTLDDGIANKTLCMRQANRDKGQRSPFEAFSGSLSGYDWNMISARGENMPANKAWRFGPDAMERFENEERDFLARHLNETRYVARLARFYLKRTGADVWVTPGRLTSDLRWAWGLDSILSGHNREEAVDPAKNRNDHRHHAIDAVVVAMTDRGMLQKVATAAGRAEERFDRRLLSELDDPWDGFREHVRDSVLSIVVSHKPDHGVEGALHEDTAYGIVKDPETGENRLASRKPLTALTPAEIKRIGDLGIRKELLERTDGLSKAEFQAELESYSREKGVRRVRVHKTEAAYEVIRHGNGHEKAVIPGENHCMDIVKTPDGVWRGVGVTRFAANREKLNGGGEPAWKRKYPDARHIMRVHKNDLLKLEKDGIETVMQVVRLNPSSNRFYLVEHFEAGDYPKRHDNDNDDFRWDLASFSGLKDRKARLVHVDPGGGIRDTGPPE

SEQ ID NO: 9165 - protein, 1121 aa, unidentified
  REGION 1..1121: note = Description of Unknown:uncultivated organism sequence
MQWRLGLDIGTNSIGWAALSLIEEGTDRNGKTIWKPGGLLNLGSGVRTYSDGRNPKDMQSLAATRRVPRGMRRRRDRYLKRRGKFMELLIAHGLMPADETKRKAVENEDPWALRARGLDEELSLHELGRALFHLQQRRGFKSNRKTDASDSDRGAIKEAAQKLVERMATQDARTLGQLLGRPRLVRLAENGELPEGQRKPMPGTRARPKAQGNKNIYDFYPTRDLIGQEFVELWKAQKEFHADRLTDKAYEELKDTLLHQRDLKPQPVGKCALDPAEQRAPRALPSVQRFRIYQEINHLTVRRPGEPERKLMLEERDKLVQKLLSSGQVTFDAIRKELKLPDDARFNLESLKRKYLDGDKTAAILATEGKKNTRWGKTWRELPEKKQDAIVAILLGQERGGMHFESTAKFVAEALDISEERAAELLETTSEDMLFQWLVSDFGLDGKRAIAAVNASLPDGHANLGRTAVGKVLEWLAGDKPQAEWIDPKTGEVKTFIAPFTYDQSVVLAGYPSHSALDGDKGGHDLLPYYGEVLKRHVAFGTGEPEDLDEKRVGKLANPTVHVALNQVRRVVNALITRYGPPTQIVVELARDLPLSADGKRDLERKQNENQTANEERRKILGEHNVSDTYENRLKLRLWEELNPDNPLDRKCPYSGSQPGKQIGIETLLSSDVDIDHILPFSKTLDDSVSNKTVCFLQANRDKGNKSPYDAFSASPGDYDWDWISRHAINMPSNKSWRFGPDAMERYENEERDFLARQLNETRYIARLTKTYLECIGADVWVTPGRLTSDLRWTWGLDSILPGHNVNQSEFREKNRNDHRNHAIDAIVVGLTDRELLNKVAKNAGRAEQEFTDRLFADLPDPWPDFRETVRKSIEATVVSHKPDHGVNGALHNDMAYGLMTEADTKGKRQVVHRVPLSSLDKPADLDAVRDPVIREHLKAETEGLTGKDFTDALVTAGENMTPPVRRIRIVEMLSVIPICDKQGRAYKAYKGNSNYCYDIFAGFNGKWTGEVVSTFDANQKIFDPKSRIARNGSPLIMRLRRNDMLAVEEDGQTKIVKAVKISSGKVTFVEHHEANEDKRHRDKEEDFSMTTRGPTALQKMRARIVHVDPAGNIKDPGPPR

SEQ ID NO: 9166 - protein, 1070 aa, unidentified
  REGION 1..1070: note = Description of Unknown:uncultivated organism sequence
MFYRLGIDIGETSIGWFILQLDKKLEICDIVDGGVYIFPDGREAKSREPLSVSRRTARGIRRNLDRKNNRKRRLIRLLEETGIWPDGIAEQKKLETLDPFVLRQKAVNEKISLPELGRVLFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGNSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAARLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADIAIRSKLLDLLQNIEDKKQRQQLTEEFMAETGIRRVRCHIEKSDSVMIPVKDNGGQIYKYYESGNNSRADIYCATKGKDAGKWKCEIISTYSANQKDFVPEWRRRDPHAKLIMKLHINDMVAYDELNKETGQTERVIARVKKMTSGLVYFRSHLIAKEEADKLSKKFSASQMQEKNLRKVYVDAMGKVKDPMFKNERKVS

SEQ ID NO: 9167 - protein, 1077 aa, unidentified
  REGION 1..1077: note = Description of Unknown:uncultivated organism sequence
MENKKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRDMYESELRRIWDCQRKYHRNLTDEMLNEISGALFFQRPLKIPERGFCRFEPGERRAYKAYPVSQKFRILQEVNALEILDIAGNGEGITLSMRQKLARALLENDRKIVNKKGIATFAKIKKFLGIPQSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 9168 - protein, 1070 aa, unidentified
  REGION 1..1070: note = Description of Unknown:uncultivated organism sequence
MFYRLGIDIGETSIGWFILKLDKKLEICDIVDGGVYIFPDGREAKSREPLSVSRRTTRGIRRNLDRKNNRKRRLIRLLEETGIWPDGIAEQKKLETLDPFVLRQKAVNEKISLPELGRALFHLNQRRGFKSNRKSDGKESESGKIKLAVQALETQLAEQGCRTYGEYLCRRHEKRISTKVRPTADSKGYEFYPTREMAEHEFDLIMSRQQQYHPELTSEVTEALRDVIFFQRSLRPQAVGKCELEPQENRAPVWHPLFQRFRILQEVNNLDLVKSTPDEIGLTAEQKKKILLMLQEGTGLNKQGLLLFTKIKSKLNIPTKRKFNLQSDKRTGLQGDWAAWKLSDDNCLGKGWFKMSPGRQVELLELLHNAEDDGKLKQDLIDLFGLNEEQAENVAKLNLPEGYASLSLKAIKNILPYLEQGKVYSEACTLAGYNHSDRRTGEIYDYLPYYGRILKSAVIGGRFEGEEPDVDEDIGLQEVYFGKINNPTVHVGLNQLRKVVNEIISRYGKPQQVVVELARELKLGVEGVRKLEKRQKENQKDNEKIAEELERAGQPNTYQNRMMYKIWERLAENPSQRCCPFSGRPISVSDLFSGAFEIEHLIPFSRSFDDSINNKVISSRDANRFKAERTPYEAFGSSPGNYKWEEIVARSENLPREMQWRFSADAMEKFAEEDGCLARMLTDTQYFARCALQYLEAICENQSKDRKMAWGIPGQLTAMLRDKWGLNSLINPADRKDRSDHRHHAVDAFVVACTSRSLLKKMADAVRLYEKTDEGEYKQIREKREKLIENMPLPFENFDREKLQQWVNGLVIAFKPDHGVQGQLHRDTCYGYIEKGSNKGSSVFAVRKDLRAVVEGSAKDGNKKINEIADVAIRSKLLDLLQNVEDKKQRQQLTEEFMAETGIRRVRCHIEKSDSVMIPVRDNGGQIYKYYESGNNSRADIYCATKGKDAGKWKCEIISTYSANQKDFVPEWRRRDPHAKLIMKLHINDMVAYDELNKGTGQTERVIARVKKMTKGLVFLRGHLIAKEEGDKLSWGASANQMQEKNLRKVYVDAMGKVKDPMFKNERKVS

SEQ ID NO: 9169 - protein, 1077 aa, unidentified
  REGION 1..1077: note = Description of Unknown:uncultivated organism sequence
MENKKVFGFDMGANSIGWCVQIIGEDGFTLEILGMGSRIFENSRDPKTRVPLSVERRMAHAMSVRRGRQIMRTRNLCSILRKYGLLPSGENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYADRGMYESELRRIWDCQRKYHRNLTDEMLNEISGALFFQRPLKIPERGFCRFEPGERRAYKAYPVSQKIRILQEVNALEILDIAGNGEGITLSMRQKLARALLENDRKIVNKKGITTFAKIKKFLGIPQSLNFNFESESRKGFDGDSTAAVMGSAECFGDAWADMDDCLCEKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGKINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 9170 - protein, 1077 aa, unidentified
  REGION 1..1077: note = Description of Unknown:uncultivated organism sequence
MENKKVFGFDMGANSIGWCVQIIGEDGFTLEILGMGSRIFENSRDPKTRVPLSVERRMAHAMSVRRGRQIMRTRNLCSILRKYGLLPSCENVSVSERNPYKLRAKAVSEKVDMFGIGRAILHMNKRRGFKSNRKADKKSDGAESRGMKLGISKLREAMGDRTLGEFLYERKKSGMGTRMRADAIRGKNEYEIYAYRGMYESELRRIWDCQRKYHRNLTDEMLNEISGALFFQRPLKIPERGFCRFEPGERRAYKAYPVSQKFRILQEVNALEILDIAGGGEGITLSMRQKLARALLENDRKIVNKKGIATFAKIKKFLEIPRSLNFNFESESRKGFDGDSTAAVMGSAECFGDAWADMDDCLREKIVDLILADKEGEFAALCAEKFGFGAEKSCAILDAGGELKDGTVSLSAKAMRKILPHLEGGALYHAACAEAGYDFTADYDGERSDLLPYYGKILRTSVLGGNPNFDPEKQPEKYYGEINNPTVHVALNQLRKVYNKLVAVYGRPDMVAVETARELPLGAKGLGELLSEQGKNRGKNLEIAEELKKFGAANNYRNRMKYKLWEDLNPDCIKRACPFCGRPIELQKLFTPEFEIEHLLPFSETFDDTRANKVVSCASCNRILKGNRSPYDAFANRAGYDWNGILSRVSDMPKSKQWRFRPDAWEIFEEKYGDYIARMLNDTRYMSKLAREYLTSVIEPEKILTVTGSATSMLRAKWGLDAILDDSSPLQFGGESESSAVKAPKAPVKNREDHRHHAIDAFVISSLNRKLISAISQCAKRAEQAHLENLFKAIPRAYERISYEKLEAAVKSINVSHKLDRGDAKGALKRGGTVAKLHKETAYGMIGSPYGGKATLAKRVPILSVECDEGQISEIANAKIRADLSRFCEQVYREAATKEEKKSMWARLLGEYCASNKIRRVRIHLPNRELKKLIPISDKKGKVYKYMENAESYCIDIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 9171 - protein, 1127 aa, unidentified
  REGION 1..1127: note = Description of Unknown:uncultivated organism sequence
MILSTQKYIIDTKGCNMKYKLGLDLGSTSLGWAIVELNEKDTPIRLVDMGVRIFPDGRDAQSHTPINAVRRQARQMRRRVDRIHIRKKRVLQLIHKYGMDFDIRTDKNLENPYELRVRALTQKLFSSELGRVLFHLSLRRGFKSTRKETRGEDGGNLKRATTALRTAMGDETLAQFQMQTGKYRFANQFDGTTIKDGALYPTRDMYLDEFREICKAQNLPDNIRQEFERAIFRQSPLKPVDVGKCVFEPEEPRAYKFEPDFQKWRALQQLNQLAILDKGIAIPLTGEQRSKLFNVMFNTFDGVSFEKNGRAKITFAKIKQILGLSRTSKFNLESEKRKDLDSDATGGAFYKIGEIEFWNARNDAEKSDILNRINDDKTDDSDLINYLVQEYGISAERAEQIIDIPLEEGVSNVSLKAIRKMLPFLEQGDLYHIAAQNAGYKHSEKDIPELDSLPYYGDLTALRPSLVPDKNGVYRTMNATVHIAMNQIRAVVNDLIHQYGKPYAINIEMGRDTRAGAQERSEIDAQQAKNKRENDRIRKELASIDITNPSREDFQKFKLWEALAKKPQNRMCVYTGRPITSLTELFKSGNFEIEHILPFSLTLDDSLANKTISAIDANKFKGNRIPYDAFNDPASPWSYDDVLRRAQNLPDSTKWRFNENAMERYLKDNPDCIARALNDTRHMTKMAVTYLQHICNNKSKVVGVNGQMTAMFRDMWHLNWWKDRADADKYRGSHIHHAIDAFVITCISPNMYYHIARNASTAEHYFGKSQKEKRDIWFADMATPFDGFDYYDFKMKCENTIISYRKSIKDPRENGTVGCLHEETAYNLESFENDKTIKATMSRRVELPKTDEKREKFKKDFKNINKTTLQMFLSDTGVTNDDADIVPKFLDWCTARGIKKLRMLKNDVDISTYIPVFRTKKERNEYLRAYENWYVADGISAGIKNKHAKQEQLNKERELLDNFKSAAKRAYKWYVGGNNFCADIFEIRSDDKHYPKDAGKWKVDIVSNYMAETNPGVSLWHKKYPTARRIMSLRINDMVMAEFSKDDPQLPSGIRDTVAHQCAVENKDTVNMVFRVKKLNSSGTIYLRPHFIAKEDADTKSWIASTTSLKEHKARKISVSPTGKILK

SEQ ID NO: 9172 - protein, 1195 aa, unidentified
  REGION 1..1195: note = Description of Unknown:uncultivated organism sequence
MTESRKMWRLGLDMGTDSIGWAAIELQGGEPTGLLDMGVRIFNDGRDPQTYESLNLNRRTARLMRRQKYRRLRRQKLIKNLLIRHGYFPEEPEKQEELKLLNPYVLRKKALDEKLEKYELGRVLLHLAGHRGFKSNRKTDAQDKEMSELKKKMSALEEYLKTKNYRTLGDYLYEEKLPKDYKEGVGKPFPQGPEAGLRFRPESSEFFPTRSLYEHEWDTIRQVQEKFHHDLPWDKVREKTYHQRPLKSQARGLCFYTRQKRAWKFLPTMQRFRIYQEVNNLKYWEVHENTRWRGETKTLTLEQKQLLAECLDGVRDAKVSGKRNQMYLSWAEIKKILGLKDKNYEFNLEKEPQRREGGLLANWIAYTLKKPEYFGDGWSTLTDDEQDNIVKKLYVEHDEGKLREYLKNWVKKEHQLQALLDFNVGLSTTASVSLKFARDVLVYLRQGLIYREAAEKAGYSFKTNEGFEDGTRAQLPYYGEILWDVVVNRGAVESEDEDELKKEGDTQKPSEEKPSEDDPNYLKNAIEYYGRIGNPTVHIALNQLRKLVNKLIQRFGKPAEIVVEMGRDLKATKKKRDDISKKNAQQKKENDRIRKELQEKRISKPSSWDIKKYKLWEELGRDQFSRVCLYTGKTINLDKLFSDEVEIEHILPYSRTLNDGMSNLTVSYKHANAYKGNRTPWEAFHDSNDGYDWRAILERVKRVFNPIGVDRDKQKYFEIKRSRFEKDALENYKQGEEFIESQLTDNHYIARSTRRYLSAICPPEKIWHSVGSITAKYREVYGLNKILQKETFNNDDDKTHKNRSDHRHHALDAFVIALVDRSVLQRVNTLHAQNRLGMKDFEAWKKVLPKPPSWINLQEKIKNIVPSLRVNHKLNGQFFMETALGHPRVIQGVNVLQLSDYLDLKNERDLEFIVSKKIRNEFKELYAVHKNTDKVLQELSKMYTVIYINQPLYVSRSSTAMLKDENKLNLIYDPVVLKAWKDFSSLPGEKRDLQQFFKERNIKHLRTKSFSQEACEVPSAPYKFYCLSDFLFVDVWFVPEHRSNGKKQSARYQGVFVSRWDALREKLKKVDLSLRKPHPAAKKKGRYYKDDVLYLIPKDKTSEPIWVKVKGFSTTDNKMDIYPIYVSDELVKWVRNVPEPLLPKLPKFLEKYKGYSREKKIPQNFISINVLFQDFEVQKVFVDVDGEVKLPIHKT

SEQ ID NO: 9173 - protein, 1079 aa, unidentified
  REGION 1..1079: note = Description of Unknown:uncultivated organism sequence
MTNNAKWRLGIDLGTNSLGWAALELVRDGDGDLAPYGLKDSGVRIFSDGRNAKDKQSNAAKRREPKGARKNRDRGKRRAARLFQQLIKYGLMPADKKEQKALEGGKGMPLCDSDPWILRYRALNKKITLSQFARAIFHLHQRRGFKSNRKTDRADKNESGKVKIAIKETLAKLKEKNACTLGELFGRERFEVYEFNEAAPKGKRKPQPLARVRKSGEGAKWQYDYYPTRELILDEFDKIWEKQSEFYDKLSDEARDAIRHTIEWQHPLKAQPVGKCTLIPEQERAPKALPSSQRARIFQEVNNLKFAPAGKLSYSLSLEQRNLVTNRLLLPTNKTGKVSFIQIRKLLGISEKFNLESEKRKDLVGDETAARMIQDECWGMAWFNFDLQTQDEIIDKLINEEKEEVLIAWLMQKHGLDKEQAENITECNLVAGYGNLSKEALDKILLPLEAEVIVYSDAVVKAGFVSHSQFGDGVIFDECLPYYGKILERSVAFGTGNPKDIVEKQYGKIANPTVHVALNQVQKVVNDLMKRFGAPEQIVLELARDLPLSAKGKGELETKQKQNQDANEKRRKSLAETYNQPDSYENRMRLRLYEDLEALGKCCVYTGEQIGAHNLFSYEVEIEHILPFSRTLDDGYANKILSMRKANRDKGNQTPFEAFGHSPDGYDWEETSERSSALPKSKAWRFAPDAMERFDNEEQDFLARQLNDTRYISRLAKGYLEAIYGGQGHKGSENNVWVINGRLTADLRHLWGLNSVLRGHNEPEAEAQKKNRQDHRHHAIDAIVIACTDRGMLQRAASEAKKQEEKFNNNLMKDIDEPWKNFRSDVEVSVRNIKVSHKPDHGFEGAMHNETAYGFLKGKEGETDKKGYQKVVTRKPLDSFDSTKDLSIIKDDLIRNKLEEETYGLTGKDFKEALLQTAHNMKPPVYKVRVEKNLRVIPFKDKQGKAYKSYMGNSNYCYDIWVSEKGKWVGEVISTFDAYQLARKDKKWWKNLIGQNEQKLIMRIRKNDYLQVEHEGEIKTVQIYKFSKGMINMAEHFEANIDARMRAKELKSIQMAPSSLQISKAKRVTVSPSGVINIY

SEQ ID NO: 9174 - protein, 1085 aa, unidentified
  REGION 1..1085: note = Description of Unknown:uncultivated organism sequence
MAWRLGIDLGTNSLGWAALDLRRDGEDLTPIGLMDSGSRIFSDGRNPKDKQSNAAKRREPRSARKNRDRSKRRSARLMRELIEFGLMPADEKERKALEGGKNKGDKKTALCDSDPWILRTCALYEQITPYQLGRAIFHLHQRRGFKSNRKTDRADGKESGKVYDATKRTKDKMQEAGAKTLGELFGRPRLEAFEFNKTAKKGERKPQPLARVRKSGEGAKWQYDYYPTRELVLEEFDKMWESQKKYYDRLSEKAYNRLRDTIEWQHPLKAQPVGKCTLIPEEPRAPKALPSSQRARIFQEVNALRIMPAGKVSYALNKDQRDIITNRLLHPTNKTGKLSFTQIRKLKNLSIYDSFNTESEKRKELQGDETAAQMMQENRWGQAWFDLSLKNQDEIIWRIIDEENEDVLVAWLQESYGFDKEQAERIADCPLPSAYGNLSEKALSMILPPLVSEVIVYSEAVKKAGFESHSQFGTGEIFDEGLPYYGEILERSVAFSTGDPKDMHEKRYGKIANPTVHVALNQIRAVVNDLMLRFGAPEQIVIELARDLPLSAKGKGELEKTQSDNQKANEKRRDLLLNTYKQSDSYENRMRLRLYEDLEALGKRCVYTGEQIGAHNLFSSEVEIEHILPFSRTLDDGYANKTLSMQKANRDKGNQTPFEAFGHSPDEYDWEEISKRAAELPPSKRWRFNPDAMERFEKDGGFLARQLNDTRYISRLAKGYLEAIYGGQGHEGSKNHVWVINGRLTADLRWQWGLDSILHGHNLEVAEAQKKNRHDHRHHAIDAIVIACTDRKMLKQAADAAKEQENKFDDRLMKNTKEPWDNFRSDVEDCVRNIIVSHKPDHGFQGAMHNDTAYGIAKGEEGKPNKKGVRAVVTRKPLDSDSFKSCSDLDKIRDDIIRKTLQEVTYGLSGKDFKQALLQTAKAMKPPVYKVRVIQNLNVIPFKNKKGEKYKAYKGDSNYCYDIWLNEKGKWEGEVISTFDAYQLSRKDKNWWQKLRGQNEQELIMRIRKNDYLQIEHEGRKKIVQIVKFTNGQFAMAEHFEANVDARTRDKDDDLKFIFKSPSSLQSAKAKRVTISPSGKVNIYQ

SEQ ID NO: 9175 - protein, 1075 aa, unidentified
  REGION 1..1075: note = Description of Unknown:uncultivated organism sequence
MNWRLGIDLGTNSLGWAALELEKYGEALKPIGLMDSGARIFSDGRNPKDKQSNAAKRREPRSARKNRDRGKRRNARLMRQLTEFGLMHADPAERKKLVGRKGIPDADPWILRTRALDEQITPYQLGRAIFHLHQRRGFKSNRKTDRADSESGKVYDAVKSTNQALKDKGARTLGELFGRPRLEVARHNQDALKGERLAQPLARVRKSGEGAKWQYDYYPTRELILDEFDKIWKAQQQYHAGILTNSARNRLRDTIEWQHPLKSPPVGKCSLIPEEERAPKALPSSQHARIFQEVNALRVGSLVETKIPLTLEQRNLVAASLLRPTNQKATRTFNQIRKNLGLSVYDNFNIESTKRTALVGDETAARLMQKDRWGQSWFDLDLVTQDEIVDRLINEEEEDRLAAYLCDVHGLDKDQALRVADCPLVAGHGNLSKLALDRILPHLEAGLIYSDAATIEFGDHRPVGTGEVFDEKLPYYGEILERSVAFGTGDPKHPDEKRYGKVANPTVHVALNQVQKVVNDLMKRFGAPEQIVLELARDLPLSAKGKGELETKQRENQQANERRRAQLINEFKQADTYDNRMRLRLYEELEALGKRCVYSGEQIGVHNLFSSEVEIEHILPFSRTFDDGFSNKTLSVRQANRFKGNKTPFEAFSHSSDGYNWQEISKRASALSPNKAWRFAPDAMERYEKEEGGFLARQLTDTQYISRLSKGYLEAIYGGQGHEGATNHVWVINGRLTADLRWNWGLDSVLRGHNEEISEAQKKNRNDHRHHAIDAIVIACTDRAMLKRAADQAQKQENTFDDRLLAGLKEPWDGFRSDVENSVRNIIVSHKPDHGIEGAMHNDTAYGIPKGKDGQPDKKGVRTVVTRKPIDGESFKSPKDLEKIRDDEIKLKLLDATQGLSGKEFKAALIMAANAMSPPVRRIRVKEKLRVIPFRDKTDKEYKAYKGDGNYCYDIWMNEKGKWTGEVISIFEAYQLARKNKNWWQEPVGRNGQKLIMRLRKNDYLQVEHEDKTKIVQVYKFSTAKINMSDHFEANVDARVRIRELKSIQMAPSSLQKSKAKRVTVSPSGVVKIYQ

SEQ ID NO: 9176 - protein, 1115 aa, unidentified
  REGION 1..1115: note = Description of Unknown:uncultivated organism sequence
MLLIGNLGGTVTWRLGIDLGTNSLGWAALELEKDREVWKPSGLMDSGVRIFSDGRNPKDRQSNAAKRREPRSARKNRDRGKRRSARLMRQLTMHGLMPADPTERKKLEGGKNMPLVDTDPWILRARALEEKITPHQLGRAIFHLHQRRGFKSNRKTDSGDSESGKVYDAIKRTKKALESKGARTLGELFGRPRLEVAKHNETAPKGQRLAQPLARVRSRGAGAKAYYDYYPTRELILDEFDQIWESQKRFYPDLTSEAKVRMEKARKELRDTIEWQHPLKSPPVGKCTFIAELRALGYGGDGSGSDEDWRLRKQLERAPKALPSSQRARIYQEVNALKIMPSGKAGYTLGKEQRDLVANSLLNSTKRTFDQLRKLLKLSEYDRFNTESEKRKHLDGDLTALKMKHKDRWGASWFDLDLQTQDEIVDRLINEEEEEKLVVWLCNTYGLEKDQALRIADCPLVAGHGNLSKLALDRILPHLETGLIYSDAVVAAGFSSHSQFGTGEVHDEKLPYYGEILERSVAFGTSDPNDMHEKRIGKVANPTVHVALNQIRAVVNDLMRRFGAPEQIVLELARDLPLSARGKGELESRQKQNQDANDVRRKRLAEEFKQPDSYDNRMRLRLYEDLEALDKRCVFSGEQIGAHNLFSPDVEVEHILPFSRTFDDSYSNKTLSMCRANRDKKNQTPFEAFGHSPNGYDWEQISLRAAALPANKAWRFAPDAMERYENEERDFLARQLTDTQYISRLAKGYLEAIYGGQGHEGSKNHVWVINGRLTADLRHIWGLNSVLRGHNEPESVAQKKNRNDHRHHAIDAIVIACTDRAMLKKAADKAKENEQMEKGALMKGVPTPWGNDKTFRIDVENSVRNIVVSHKPDHGIQGAMHNDTAYGIPEGKEGEPDKKGVRLVVTRKSLDSESFKKPDDLEKIRDHTIKMKLLEETYGLTGKEFKEALLEAARAMVPPVYKVRIEENLRVIPFKDRSGKEYKAYKGDGNYCYDIWVNEKGKWTGEVISTFQAYQLSRKDPKWWQKPVGRNGQKLLMRLRKNDYLQIEHDEKRMIVQVYKFSEGKINMAEHLEANVDARVRAKELKSIQKAPSALQKSKAKRVTVGPSGVVKIYQ

SEQ ID NO: 9177 - protein, 1051 aa, unidentified
  REGION 1..1051: note = Description of Unknown:uncultivated organism sequence
MKKYRLGIDLGATSLGWCMIELNEENSPKDLIELGVRIFPDGRDAKTNEPLNVKRREHRSMRRNRDRYLQRRAYLMDILVKYGFMPENEKERKQLEHLDPYFLRVKALDKKITLYEVGRIIFHLNQRRGFKSNRKLDNAEKDSSRMKEAIKELKQKFKEDGTRTLGEYLFNLNITKNREQNRRIPIRIRDHGKEYNLYTERSMYENEFDMIWDKQSEYHSELMEQKKEHLKQIIFFQRPLKPQPKGKCRFELDQPRCPVAFPVYQQFRIYQEVNNLILFDFDRNEHELTSAQRETITQILLKQKSATFKSLRKKLGKEFAGDYVFNLESEKRKDLKGDETSFIMRKADYFDEKWDSFTELEKDEVITRLINEDNDLEIENTLVSWLCDTFKITKENAEKIKDIRLPQGIGSVSKKAINKILPYLKEGYIYSDACSNAGYHHSDFRTGEVYDEGDLPYYGKIIPHAVAFGTDDPNDIDEIQYGKIANPTVHIALNQMRKFINALTKKCGAPSQIVVELARELKLGQKRLREIEKEQSMNRKHNEEIADEIKKLGIENTYQNRLKYKLWEELDSDPAKRCCPYTGRQIPLNAVDGLFSNKFEIEHILPKSKTFDDRPANKTVSYYQANRFKGERSLFDAFGENPENYNWEKILDRGEKLPRNKRWRFYPDAMKNFQDQGELISRMLTDTQYMSRVAKEYMSYVCGDKNVWAIPGKLTAKFRAKWGLNELLSENKEKNRADNRHHAVDAFVVACTDRGMLQKVARATEKSRERFIEKMPLPFEDFSHDEMQKKVNNIVVSYKPDHGNAKSAITDCKQKGKRKTVGQLHDETAYGFVSENEEKGKITLSIRKPLTSLYSIKNIQEIASTKIRNELVKLTDAIPQKEIKAILSQYSEKTGIKRAKIHVEKDAKTVIAILNKKGEVYKYYLSGNNYCADIYSPNKGKKAGKWQVEIIPMYYAHQPNFEPEWHKKYPTAKKIMRLFKNDYVAYDEDGERKIRRVKKMNVDGRIFFIDTKIAISDKGINATSVKQLQDRNARKIGVDILGRVYDNKKEK

SEQ ID NO: 9178 - protein, 1048 aa, unidentified
  REGION 1..1048: note = Description of Unknown:uncultivated organism sequence
MKKYRLGIDLGATSLGWSVLGLDKDNSPKDLIDIGVRIFPDGRDAKTNEPLNVQRREHRSSRRNRDRYLQRRAYLMDTLVIYGLMPKNEDDRKQLEYLDPYFLRAKALDEEISLFELGRAIFHLNQRRGFKSNRKLDSAEKETSRMKDAIKELKQKLDDADARTLGEYLYNLNNDVPENQQHKKRPARIRDFGKDYNFYTDREMYSDEFDMIWEKQSKYHDELIEKKKEYIKRIIFSQRDLKPQPKGKCRFEINEFRAPVAFPIVQQFRIYQEVNNLILLDFDRKEHKLTNEQKDIIITTLLKQKTAAFKSLKKKIVKDNPEEFVFNLESEKRKDLKGDETSYIMRKDEHFWKIWDDLSESEQDEIIRRIINEDNVVEIETTLSTWLQENFDVTEEQALHIKNVRLPQGISSLSIKAIKNILPYLKEGYIYSDACAKAGYHHSDFRTGDVYDECDLPYYGEVMPGHVAFGSNDPDDIDEIQFGKIANPTVHIALNQLRKFVNALVKRYGAPSQIVIELARELKLGQKRVKEIEREQTENRKHNEAVAEELGKIGIENTYQNRLKYKLWEELDADPTKRCCPYTGKQISIADLFSNKFEIEHILPKSKTFDDRPLNKTVSYYLANKYKGERSPYEAFGNSPEDYNWDEILERGKRLPPKKRWRFFPDAMKNFDDSGELISRLLTDTQYMSRMAKEYMSYVSGPNNVWAIPGALTSKFRAKWGLNELLSEDSEKNRADNRHHAIDAFVVACTDRAMLQKVARATEKSRERFIEKMPPPFEDFSYDEMQKKINNIVVSYKPDHGNAKAAIKNDQTVGQLHDETAYGYVSETEDKITLSVRKPIRDLNTIKKINEIADDHIRKTLLKAIEKNKDKKIDEILKDFGSTSGIKRAKIYVEKDKKTVIPVRNIKGEIYKYYLSGNNYCADIYCPDKGKKAGKWQIEIIPMFYAHQKDFEPEWHKKYPTAKKIMRLFNNDNVSYIEDGNRIIGRVRKMTGNTVYLRELNIAKKEKGREDIGEQFRPAKLQDMNARKVGIDILGNVFDPQRYEYNRD

SEQ ID NO: 9179 - protein, 1047 aa, unidentified
  REGION 1..1047: note = Description of Unknown:uncultivated organism sequence
MKKYRLGIDLGATSLGWSILELNEDNSLKGLVDMGVRIFPDGRDAKTSVPLNVKRREHRGIRKNRDRYLQRRAYLMDTLVKYGLMPEKEMERKQLEHLYPYFLRAKALDEEISLYELGRAIFHLNQRRGFKSNRKLDSAEKETSRMKDSIKELKKNLNEAGARTLGEYLYKLNIDVPHNAQHKKRPQRIRDYGKDYNFYTDREMYSDEFDLIWKKQSEYHTELTDKKKEHLKEIIFFQRPLKPQPKGKCRFELEEFRAPVAFPIVQKFRIYQEVNNLILLDFDRNEHELTNEQKEIIIQALLKQKTATFKSLRKKFGKEYDEYIFNLESEKRKDLKGDETTFIMKKDLHFGKKWDLFSDSEQDEVIRRIINEDNDIEIEATLITWLQENFGLNEENAQHIKEVRLPQGIASLSKKAINKILPYLMEGYIYSDACAKAGYHHSDFRTGEVYDEGNLPYYGKVMPHHVAFGTNDEDDIDEIQYGKIANPTVHIALNQLRKFANALVKKYGVPTQIVIELARELKLGQKRLKDIEREQTANRRHNEFVAEEIKKIGIENTYQNRLKYKLWEELDNDPAKRCCPYTGKQISISELFSNKFETEHILPKSKTFDDRPLNKTVSYYLANRFKGERSPFEAFGESPENYDWEAILERGMNLPPNKRWRFYPDAMKNYEDQGVLISRMLTDTQYMSRTAREYMSYVCGPDNVWAIPGALTSKFRAKWGLNQLLSDDNEKNRADNRHHAIDAFVVACTDRALLQKVARATEKSRERFIKKMPLPFKDFSHDKMQKKVNDIVVSYKPDHGNAKEATKKNRTVGQLHDETAYGFVSETENKIMLSVHKPLRGLNTLKKINEIADGNIREALIGEINKNKEKKIDDILDAFIQKTGTKRVKIHVEKDKKTVIPIRNKMGNIYKYYTSGNNYCADIYCSDKGKNAGKWQVEIIPMFYAHQQDFEPEWHTKHPTAKKIMRLFINDYVAYDDNENRKIVRVKKMNIDGRLFFIDPTISKSEKDPNATSVKQLQERSARKVGIDILGNVFDPQRHEHNRDKKE

SEQ ID NO: 9180 - protein, 1041 aa, unidentified
  REGION 1..1041: note = Description of Unknown:uncultivated organism sequence
MKKYRLGIDLGATSLGWCMIELNEDNSPKDLIELGVRIFPDGRDAKTNEPLNVKRREHRSMRRNRDRYLQRRAYLMDILVKYGFMPENEKERKQLEHLDPYFLRVKALDKKITLYEVGRIIFHLNQRRGFKSNRKLDNAEKDSSRMKEAIKELKQKFKEDGARTLGEYLFNLNITKNREQNRRIPIRIRDHGKEYNLYTERSMYENEFDMIWDKQSEYHSELMEQKKEHLKQIIFFQRPLKPQPKGKCRFELDQPRCPVAFPVYQQFRIYQEVNNLILLDFDRNEHELTSAQREMITQILLKQKSATFKSLRKKLGKEFAGDYVFNLESEKRKDLKGDETSFIMRKADYFDEKWDSFTELEKDEVITRLINEDNDLEIENTLVSWLCDKFKITKENAEKIKDIRLPQGIGSVSKKAINKILPFLKEGTRLYVSQIKAGYTVGRTGEIFDEGNLPYYGKIIPHAVAFGTDDPNDIDEIQYGKIANPTVHIALNQMRKFINALTKKCGAPSQIVVELARELKLGQKRLREIENEQSINRKHNEEIADEIKKLGIENTYQNRLKYKLWEDLDSDPAKRCCPYTGRQIPLNAVKGLFSNRFEIEHILPKSKTFDDRPANKTVSYYQANRFKGERSPFDAFGENPENYNWKKILDRGEKLPRNKRWRFYPDAMKNFQDQGELISRMLTDTQYMSRVAKEYMSYVCGDKNVWAIPGKLTAKFRAKWGLNELLSENKEKNRADNRHHAVDAFVVACTDRAMLQKVARATERTRERFIEEMPSPFYDFSFQDTSEKVDKIVVSYKPDHGNAKAAILRDQTVGQLHDETAYGFVSEDEEKGKITLSIRKPLTSLDSIKNIREIASTKIRNELIKLTDAIPQNEIKAILSQYSEKTGIKRAKIHVEKDAKTVIAIRNKKGEVYKYYLSGSNYCADIYCPSKGKKADKWQVDIIPMFKAHQSNFEPEWHKQNPTAKKVMRLFINDYVAFDEDGERKIRRVRKMTGNIVYLRELNIALKEKGKEDIGEQFRPSTFQAKNARKIGIDILGNVCD

SEQ ID NO: 9181 - protein, 1144 aa, unidentified
  REGION 1..1144: note = Description of Unknown:uncultivated organism sequence
MKYRLGLDMGATSIGWSVFDIESQTLINAGVRIFDDGRDNKSKASLCVKRRTARSARRLTNRKHIQMQNLLKVLTDCGLFPSDTFSRQELKKLNPYQLRKQALDKQLQPFEIGRCFLQLAERKGFRSNRKDNREEGGKLKQGYTELKEKIKEEKARTYGEFLYNQNLKNQTIRLKNTFDSAGKFLGGLFPFREIYQEEFKTIWEKQKSYYPTILTETSQQKIKDALFFQRPLKEAEEGECIFEAGEKRIAKAHPLFQEFRIWQTILNLEFSPSNSAKYLPLALQYNNELVELLCNPQNIAVTAQGVISYKNIKAALKLDKNGIFNYERSDNVTPGLEKGLLVNTTQNAINKSRYLSAFWNTMSDSQKEQLINVITRPHSYITFSNHKISIEDEDQIISKYLQQTFHLSQEAAEELLYDIDLEDGFGSLSEKAIRKILPFIKQGMRYPDACQEAGYHHSDKEYTHLTQLPYYGKLLGQSCLGKKLNPQNDEEKYGKINNATVHVALNQVRHLVNEIMQDYGQPYDIAIEYARELGASMEERKKLSDTRDKNELENQKILKELNEKIGHRDYTKRDILKYKIWQRLPFYNKNKLVRECPFSGDPISLADLMNGQKFQIEHLLPFSRSLDDSLNNKVIATVDANRYKKERTPFEAFGESKDGYDWNAILHRAKQLPAEQQWRFAPDAMKKFEEQSGPIARSLNDTSYMTRILQDYLQPIVREDGKKRVQAVAGRLTSMVRKAWDLDDYKNKEDEEQYRALHNHHAIDAFVVSAIERGQIAQVAQQLKEVKPEAARQFHDELIKLRDKNVSKEEKDKIKKKIHDFISDNEQKIIRHYFPIPETIRIHEIKKRIADIHISHKPSLKDITDTHSTIGQLHEDRAYGLHDFVDDTSLKADFTSRKDHHKEHTEKEIVDYIPMFYHKADKEAYYNAFKQWFMLDKKASTMDAKTKEEKAAKALIAKQEQAAIDDLRSAARQAFKWYVGGNNFCAEVYQINSQNKINGCLTKDQGDWKTEIVSNYNATIRHGRGENIAYWHYKYPNAKRIMTLRRNDMVLGTFTREQASQSTFPKGLTEYVQNIFNQDTCLDQVDVLLRVKKISSDGRIALTPHNIAKEDHDTKSWLANADALKTYNARKVFVTSMGKIRHAK

SEQ ID NO: 9182 - protein, 1108 aa, unidentified
  REGION 1..1108: note = Description of Unknown:uncultivated organism sequence
MKYKLGLDLGSTSLGWAAVKLNDAGAVEQLLDFGVRIFPDGRDAKTHAPINVVRRAARTMRRRGDRVKLRKKRVLQLIRKYGLDFDIRSNPILENPYELRVRALEHRLSPSELGRVLFHLALRRGFKSNRKETKGENGGKLKAATDALASAVGDGTLAQFQVQTKKFRFSNQFDGNVIKDGALYPTRDMYLDEFHRICDAQGLDKEMRAAFENAIFFQRPLIPPVVGTCIFAAGQPRAHKFEPVFQRWRALQQLNQLAILDNGQNVALTDQQRQCLVDILLYNFNGVKRDRGGRVKITFAEIKKQLGLSRTVKFNLESEQRKELNVDSTGFSFAEIGELDFWRSLTDEQQSDVLNKINDDQTEDAELIEYLVAHYGLSASRARAIIDIPLEDDVANVSVVAMKKMLPFLEGGQLYHLAVHSAGYHYGEQDVPLMDKLPYYGDLDVLKPSLMPARDGAYRTMNATVHIAMNQIRVVVNDLIERYGRPCAINIELGRDVRAGAKERAELDKQQSANKRKNDAIRAELAEIGILNPSREDFQKYKLWENLAPQPQNRRCVYTGEPITSLAALFKSGRFEIEHILPFAQTLDDSLANKTISAVAANRFKGNRSPAEAFDDPASPWAYADVWARAQNLPDGSRWRFDRDAMEKFTRHGDCIARALNDTRFMSVMAVNYLKHICSDKNKVRGLPGRLTAIFRDMWHLDWWKNHDDADTYRASHIHHAIDAFVIACMGAGNLQKLAENATHLEDFHGKTLKEKHRQLFADMYLPFPEFDYYDFRMRCEACVISYRPSVKEPAASDTVGCLHEDTAYKLEKFETGTRATMSRRIALPTTADARAKFKKDFDSLNPKTLEMFLAETGVANDANDIADQFLNWCQMRGIKKVRMFKTRVDTTTYVPVFRNRGDKNAFNRAWTEWYAAAGIARGMTEPKAKKAQQEKERRLLALYQNAAARAYKWFVSGNNFCADIFEIRSDDRRYPALAGQWQSEIISNYCATLNNGTPMWRCKYATARRVMRLRINDMVMAEFSRDNVPLLKGLEDAVRHQLAVQDTDTVNIIFRVKKISSNGAIFLRPHYIAKEDADTKTWQANATSLQKYKARKIRVSPTGKVLE

SEQ ID NO: 9183 - protein, 1031 aa, unidentified
  REGION 1..1031: note = Description of Unknown:uncultivated organism sequence
MQKKRYRLGIDLGTASIGTALVELDGPTEHPHPTNILHMGVRIFEDGRDPKTKVPLGVARREAKQARKMLDRYLRRRKRLTDALIKFKIWPEDENKRKSFCLFNPYDIRTRALDEKISLEELGRAIFHLNQRRGFKSNRKTDGGEDGKIRTAVAKLEQIFQSEGCRTLGEFYQKRLIKGQSIRARLEGAGAKAEYPFYPSRQMIEHEFDKIWDKQVEFYPNILTEDAKKVIRSTLLYQRPLKPAKPGKCFLEPSEDRAPIASPYFQRFRILQTINELRIIDRYGDKRPLTKEERDILLEELSQKKELKFSAAKKLLSLSNNNRFSIQDEGRDKFQGDQIAVLLGNKKYFGKNWKLLPIENQNEIVKALIDEQDTEKLIATLAVFGLSKEAAAQLSEETLPTGYGRLSVVALKKIVPFLEESVITYSEAAAKAGYNHSDNYTGEIFRYLPYYGKVLENRVMRGSGNEADNDEDRYGKVGNPTVHIALNQLRRVVNCVIKHFGAPEQIVIEVARDLKMTQDEIKDYKKHLAENEKRNERIDKELEKLGQSINRDNRERYKLWEELATDPMERCCPYTGIRIGIEKLFSDEVEIEHILPFAQTYDNSLANKTLSMRYANRLKQNRSPYEAFAEHSYKGILSYQEMLDRLPQDKVWESKRWRFEKGALDKYNENGDFQARQLTDTAYASRLALEYLKFICPKDSIWAIPGRLTSMLRRQWGLNSILGRELPDGTFEKSRDHHGHHAIDGLVVAMTDRALLKKMSDATQTNWENQERVLSHIDPPIVDIFDQAKERLSHLVVSHRKDHGLGGALHNDTAYGIVGEFKEGTVSTVRHKIPITSITGSNINQVENSFIRESIQNLIADFGTGASLEAAINEFSSKTGIRRVTLTEKLSVVPIKDKTGRIYKAFKPDGNYCYDIWSNGDKWEGKIISRFEANSKNFNKKQNCLMRLFVGDTLCCELNEQKKFYHILGITDGKVTLAEIHEAGNLKERDRDKKDYFKYIFKAPSKLKDFKARLVHVDECGFVYDPEFKEK

SEQ ID NO: 9184 - protein, 1031 aa, unidentified
  REGION 1..1031: note = Description of Unknown:uncultivated organism sequence
MEKKRYRLGIDLGTASIGTALVELDGPAEHPYPTNILHMGVRIFDDGRDPKTKVPLGVARRLAKQNRKMLDRYLRRRKRLIDALIEFKIWPTDENQRKALCLLNPYDIRTKALDEKVSLEELGRAIFHLNQRRGFKSNRKTDGGEDGKIRLAVAKLEKTFQDEGCRTLGEFYHNRLEKGQSVRARLEGAGAKASYPFYPSRQMIKNEFDKIWEKQAEFHPEILTEQAKTKIRDILLYQRPLKPVKPGRCFLEPSEDRAPIASPYFQRFRILQTINELRIISRYGDQRPLTLKERNILLEDLSQKKELKFSAAKKLLSLSVYDRFSIQDERRDKFQGDQIAVLLGNKKYFGKNWKLLPLENQNAIVAELINQDDTENLIKTLCAFGLSNESAAQLSEETLPTGYGKLSLVALEKIIPFLEESVITYSEAAAKAGYKHSDNYTGEIFHYLPYYGKVLENRVMRGSGNEADNDEDRYGKVGNPTVHIALNQLRRVINCVIKHFGAPEQIVIEVARDLKMTQEEIKDYNRRQAENEKRNERIDNELKKLGQSINRENRERYKLWEELADNPMDRRCPYTGKAIGIEKLFTEEVEIEHILPFAQTYEDSLANKTLSMRYANRLKQNRSPYEAFAEHSYKGILSYQEMLDKLPKDKAWENKRWRFEKGAMDRYNANGDFQARQLTDTAYASRLALEYLKFVCPKDSVWAIPGKLTSMLRRQWGLNSILGRELPDGSFEKSRDHHGHHAIDGLVVAMTDRAMLKKMSDATKINWEHQERILSHIDPPIVDIYDQAKERLSHLVVSHRKDHGLGGKLHDATAYGIVGEYKKDTVSTIRHKVPITSIKETNIEQIHSERIRLSLQNLIAESSSDSKLMEAINDYSSRTGIRRVTLIEKHSVIPIKDKNGHIYKSFKPDGNYCYDIYANGDKWEGKIISRFDANSQSPTKTNNIIMSLFIGDTLCCEKDGKRILYHILGITDQKITMAELFEAGNLKERDKNKNDYFKYTYKKASTLKPLKARIVHVDECGFVYDPGFKEK

SEQ ID NO: 9185 - protein, 1031 aa, unidentified
  REGION 1..1031: note = Description of Unknown:uncultivated organism sequence
MEKKRYRLGIDLGTASIGTALVELDGPAEHPYPTNILHMGVRIFDDGRDPKTKVPLGVARRLAKQNRKMLDRYLRRRKRLIDALIEFKIWPTDENQRKALCLLNPYDIRTKALDEKVSLEELGRAIFHLNQRRGFKSNRKTDGGEDGKIRVAVAKLEKTFQDEGCRTLGEFYHNRLEKGQSVRARLEGTGAKASYPFYPSRQMIECEFDKIWEKQAEFYPKILTEQARNKIRSTLLYQRPLKPVKPGKCFLEPSENRAPIASPYFQRFRILQTINELRIISRYGNQRPLTLKERNILLEDLLQKKELKFSAAKKLLSLSVYDRFSIQDERRDKFQGDQIAVLLGNKKYFGKNWKLLPLENQNAIVAELINQDDTENLIKTLCAFGLSKEAAADLSEETLPTGYGRLSIVALKKIIPFLEESVITYSEAAAKAGYKHSDNYTGEIFHYLPYYGKVLENRVMRGSGNEADNDEDRYGKVGNPTVHIALNQLRRVVNCVIKHFGSPEQIVIEVARDLKMTQEEIKDYNKRQAENEKRNERIDNELKKLGQSINRENRERYKLWEELADNPMDRRCPYTGKAIGIKKLFTEEVEIEHILPFAQTYEDSLANKTLSMRYANRLKQNRSPYEAFAEHSYKGILSYQEMLDKLPKDKAWENKRWRFEKGAMDRYNANGDFQARQLTDTAYASRLALEYLKFVCPKDSVWAIPGKLTSMLRRQWGLNSILGRELPDGSFEKSRDHHGHHAIDGLVVAMTDRAMLKKMSDATKINWEHQERILSHIDPPIVDIYDQAKERLSHLVVSHRKDHGLGGALHNDTAYGIIGEYKEGVVSTVRHKIPITSITGSYFNQIQNESIRYGIQDLMANSSSDAALKDAINEYASKTGIRRVTLVEKLSVVPIKNKKGQIYKAFKPDGNYCYDIWANGDKWEGKIVSRFEANTRGAKKPQNLLMRIFVGDTLCCETENKKILYHVLAITDGMITMVEPYEAGNLRERSRSKTDYLKYTFKSPNALKPIKTRIVHVDECGFVYDPGFKEK

SEQ ID NO: 9186 - protein, 1051 aa, unidentified
  REGION 1..1051: note = Description of Unknown:uncultivated organism sequence
MKKYRLGIDLGATSLGWCMIELNEENSPKDLIELGVRIFPDGRDAKTNEPLNVKRREHRSMRRNRDRYLQRRAYLMDILVKYGFMPENEKERKQLEHLDPYFLRVKALDKKITLYEVGRIIFHLNQRRGFKSNRKLDNAEKDSSRMKEAIKELKQKFKEDGTRTLGEYLFNLNITKNREQNRRIPIRIRDHGKEYNLYTERSMYENEFDMIWDKQSEYHSELMEQKKEHLKQIIFFQRPLKPQPKGKCRFELDQPRCPVAFPVYQQFRIYQEVNNLILFDFDRNEHELTSAQRETITQILLKQKSATFKSLRKKLGKEFAGDYVFNLESEKRKDLKGDETSFIMRKADYFDEKWDSFTELEKDEVITRLINEDNDLEIENTLVSWLCDTFKITKENAEKIKDIRLPQGIGSVSKKAINKILPYLKEGYIYSDACSNAGYHHSDFRTGEVYDEGDLPYYGKIIPHAVAFGTDDPNDIDEIQYGKIANPTVHIALNQMRKFINALTKKCGAPSQIVVELARELKLGQKRLREIEKEQSMNRKHNEEIADEIKKLGIENTYQNRLKYKLWEELDSDPAKRCCPYTGRQIPLNAVDGLFSNKFEIEHILPKSKIFDDRPANKTVSYYQANRFKGERSLFDAFGENPENYNWEKILDRGEKLPRNKRWRFYPDAMKNFQDQGELISRMLTDTQYMSRVAKEYMSYVCGDKNVWAIPGKLTAKFRAKWGLNELLSENKEKNRADNRHHAVDAFVVACTDRGMLQKVARATEKSRERFIEKMPLPFEDFSHDEMQKKVNNIVVSYKPDHGNAKSAITDCKQKGKRKTVGQLHDETAYGFVSENEEKGKITLSIRKPLTSLYSIKNIQEIASTKIRNELVKLTDAIPQKEIKAILSQYSEKTGIKRAKIHVEKDAKTVIAILNKKGEVYKYYLSGNNYCADIYSPNKGKKAGKWQVEIIPMYYAHQPNFEPEWHKKYPTAKKIMRLFKNDYVAYDEDGERKIRRVKKMNVDGRIFFIDTKIAISDKGINATSVKQLQDRNARKIGVDILGRVYDNKKEK

SEQ ID NO: 9187 - protein, 1067 aa, unidentified
  REGION 1..1067: note = Description of Unknown:uncultivated organism sequence
MSDARAIVLSMKNEPLRYRLGLDLGTNSLGWAMLEIDENNQPFKVIRLGVRIFDSGRKPTDGSSKAVDRRGARSMRRRHDRYLHRRNQYINALISFNLLPNEESERQKLTSLNPWRLRSEAMDKELEPFEIGRALFHLQQRRGFKSNRRVDNSVENELETTGLKGAINEFSIALAGKTVGQELWKRIQNGEPARARKVGSGQSERYAFYVDRGMVAAEFDAIWQKQASFKPGLLNENAHEVLRDHLLYQRDLLPQTPGSCFFEQDQPRMPMAYESAQLFRLYQDINNLRVKDINTLTTRPLTLDERNRAIELVLSVKEMKLSSLRKKLLGKDFDKFQFTLETTNRPAIKGNQTHAVLAKTGYFGDDWLKLSLNDRDEIARLVAFENNEHFIVNTLISKFGRTKEQASSVVQVRLPDAFLRISQRAGQKILEQLINGWDDQSDCPLTYDKAAIAAGYRSHNLNTTGEIFTNLPYYGEVLFQYTAPMPRSKVLDEAKFGKIGNPTVHLGLNQVRKIVNALIKRYGLPTQIVVEVSRDLKNGVYTKSQIERDQKDNRERNEDAVRKLIELGQVNTADNRIRLRLYDELGGIKKCVYSGRIISLSQLFSNEIQIDHILPMSRTLDNGFANKVLSHHSANKFKGNQSPFEAFGSSPSGYNWDEILDRVKALPANKLRRFSPEATPEVEGFLDRQMSDTQYLARVTHQYLRALGGLDIWVTPGRLTGLLRGKWGLNEFLSTDGVKNRTDHRHHAIDAAVIAVTDRSLLKRISTASAKAVSKDLGRDFEDFPEPWDTFRSELAEKVNRIVVSHKPEHGTEGSLHNDTAYGIEKLADSGSPSLVHHKVPITSIKESDLGYMKFPNEHMTILDLDSETLKAIGDCVLGSSKDKERQSELQKFSELTGRRSVVKREIWSVIPIFRRGDKKNPDAIPYKAYKGDGNYCYEIFEAENDKWDGRIISRFQANSNEYRAFANSKEFHHVSFNGEQLVMRLMANDCVVLGEDSTVYRVQKISAGVIVMAPANEGNVDARSRDKDDPFSFISRAPNRLKQTGARRVFVDVIGSVKDPGEKIPE

SEQ ID NO: 9188 - protein, 1047 aa, unidentified
  REGION 1..1047: note = Description of Unknown:uncultivated organism sequence
MKNYRLGIDLGSTSLGWSIIELSKGKEPTKLMNLGVRIFPDGRDAKSREPLNKQRRDHRSMRRNRDRNLQRKQHLFDCLIKSKLMPENIIEQKKLENLDPYELRVQALDKEISLHEFGRVLFHLNQRRGFKSNRKLDADDKETSTMKNAIKELENELKKAGVRTLGEYLFNLNKDIVEHHQRKPLRVKTTAEGYNLYPDRKMYEDEFEILWKKQSEYHQELNSELKERIKNIIFFQRPLKPQPKGKCRFEPDETRCPVAFPIYQQFRIYQEVNNLRLLDFDRVSHDLTDEQRTIILKAVLFQKKTAFKALRKKLGKEYAQDYVFNLESEKRKDMKGDETSFTLRKDEYFGTTWDELTDKEQDEIITRIINEDNDTKIEETLISWLCDSFKLQKENAEKISNLRLSQGIGSVSKKAINKILPFLKEGFIYSEACEKAGYHHSDFRTGEIFDEENLPYYGEVMPQHVAFGTDDSDDIDDVRFGKIPNPTVHLALNQLRKFINALTKKYGAPQQVVVELARELKNGQKRLREIEYEQNKNRKYNEKIADELEKIGVENTYQNRLKYKLWEELDRDPTKRCCPYTGKHISLNAVNGLFSNKFEIEHILPKSKTFNDRPANKTVSYFKANRDKGERSPFDAFGHNPKGYEWDKILSRAEKLPKSKRWKFYPDAMKNFENENDVISRMLTDTQYMSKVAREYMSYVCGPNNVWVIPGQLTAKIRSKWGLNELLSDDSKKNREDHRHHSVDAFVVACTSRSMLQKIARASELSRDRFIDEMPPPFTAFKHEKMKDLLDNTTISFKPDHGNAKAAILRKQTVGQLHDETAYGFVSEDIAKGKITLCVRKPLRDLNTIKKITEIVDANIRHFLLSSIEMNEDKKIDTILEEFRQMTGIKRVKIQVEKDKKTVIPIYNKKGEIYKYYLSGSNYCADIYCPNKGEKAGKWHVEIIPMFHAHQPDFEPQWHKQNPTAKKIMRLFINDFVSYNENDERKIRRVKKLSVDGRLFFIDPKIAKSDKEPNATSVKQLQERNARKIGVDILGKVYDPKQKNENH

SEQ ID NO: 9189 - protein, 1077 aa, unidentified
  REGION 1..1077: note = Description of Unknown:uncultivated organism sequence
MKWRLGIDLGTNSLGWAALELAQVDKAWTPVGLIDCGARIFSDGRNPKDKQSNAVKRREPRGARRNRDRYLRRRDRLMRQLIQYGLMPDTEVERKALEGGKGMDLTHSDPWILRTRALEEPITLHQLGRAIFHLHQRRGFKSNRKTDRGDNESGKVHDATRRTRDRLEAEGARTLGELFGNPRLETLQHNRTAARGAGLPQPLARVRKSGDGSKWQYDYYPTRELILDEFDQIWEAQRAHHAAALTDEARDTLRNTIEWQHPLKSPAVGKCTLLPEFPRAPKALPSSQCARIYQEINALRFGRTGEIKEPLTLAQRDKVAERLMHPTNKTADVTFDQIRKLLGLSSYDIFNTESQKRNKLKGDEAAARLMQKDRWGDAWFDLNLATQDNIVMRLLEEENEEKLLAWLKEQYGFDRQKAIHIADCPLPDGYGNLSAEALALVMPHLESDVRVYSKAVEVAGLHHSQFGTGEIFEKGLPYYGMILERSVAFGSGEPEDSDEKRYGKVANPTVHVALNQVRAVINDLTRRYGTPEQIVLELARELPLSARGKSELESKQRDNQIENERRSKQLEELGVANTYENRMKLRLYEDLEALGKRCVFSGDQIALSMLFTDQIEIEHILPFSKTLDDSFSNKTLATRRANRDKQNRSPYQAFGHSPAGYDWNELTKRANELPVSKKWRFGPDAMERYENEERNFLARQLTDTQYIARLAKAYVEAIYGGQGHAGSENHVWVITGRLTADLRHHWGLDSILRGHNEPTSEAQKKNRDDHRHHAIDAVVIACTDRAMLKAAADEAHQQEEAFNARLLAGIPEPWDNFRDHVAQKVRDVVISQKPDHGFQDAMHNDTAYGIVKGVNGEPDRKGIRTVVTRKPLDSEAFKSPADLQKIRDFPTMMALLEATQGLKGTEFKSALLATARAMTPPVRKVRIEEKLNVIALEDKQGKIYKGYKGDGNYCYDIWVDPKGKWTGEVVSTFQAYQLAREDKDWWTKQTGRAGQPLAMRIRKGDMVKVIVDGKPLILTVYKFSEGKLNMAEHNEANASARIREKTLNGFQMSPSSLQKADAKRITVSPSGMVKIYQ

SEQ ID NO: 9190 - protein, 1049 aa, unidentified
  REGION 1..1049: note = Description of Unknown:uncultivated organism sequence
MATWRLGLDVGTNSIGWAAIGLFQIKNTWMPVKIISSGVRIFSDGRNPKNKQSLAVQRRLPRQQRKTRDRYLKRRQEFMDKLTKHKLMPDNYESRKKLEKTDPWALRVKGLDEKLTLHELGRALFHLDQRRGFKSNRKTDKSEGDESGKIKSAAEKVVFEMKQRGARTLGEYLASPRVADPKAAHDHRVRARLHGAGAKAYYDFYPTRALIEQEFITLWQTQAQTRFHGPQLSEQAREDLLNTLLFQRDLKAQPVGKCSIDPTQRRAHKALPSVQRLRIYQEINHLSVRLPGEPERKLNKDDRDLLVKKALTTGKVTFDSMRKALKLPQSARFNLESEKRKHLDGEKTAAALAARARWGKQWRDIPIVDQEKIVHRLLDEEDGEALINWLTSAYGLTRDVAEAVGDVKLPTGHGRLSEAVGHNVLDELIKDVITYDEAVIAAGYNSHFDLDSDDEVHDRLPYYGKVMERHVAFGSGEPLDSDEIRYGKIANPTVHVALNQIRHVVNDLIKRFGPPTEIVVELARDLPLSAKQKFDLEKMQRENQEVNETRRKTLGRLGEADSSDNRFRLRLWEELNPTNPLGRRCPYTGEQIGIGRVFSPDVEIDHILPRSRTLDDSPANQTLSMRWANRLKTSQSPFEAFGHSPEGIDWQEIVQRSSTLPHNKSWRFSADAMVRFENEERNFLDRQLVDTQYMSRLAHTYLKRTGADVWVTPGRLTADLRWAWGLNSVLADHNQSEQASPGKNRFDHRHHAIDAVVIALTDRGLLKRVATMAGQAELRFDRRHLSGIAEPWKNFRETVRQSVHEIVVSHKKDHGLQGALHEDTAYGIVKDPISGESRLVSRKPLIKVSRKEVGKIGDLKIRGDIEALINGLSDSEMKTALIQYSSETGVKRVRIHKKEDHYKTIVHGDDYLKAVIPGENYCVDVVKTADGRWHGLGLSVFDANQKNPGEHWKVQFPDALHVMRLHKNDQIKLVCDGTEKIMRIIRLVPSDHRVFLAGHCDGGVLQKRHEDADDFFRWDWPTFDALKARRARLVHVTSSGRVFDPGPIS

SEQ ID NO: 9191 - protein, 1085 aa, unidentified
  REGION 1..1085: note = Description of Unknown:uncultivated organism sequence
MAFNTPWRLGIDLGTNSLGWAALKLNSDQTEITGLLQSGVRIFSDGRNPKDKQSNAAKRREPRSARKNRDRSMRRSARLMRELVEYGLMPKDKNARKKLEGGKGIPLEDSDPWILRYRALSEEISPYQFGRIIFHLHQRRGFKSNRKTDRADAESGKVHDATKRTLEKLDAAGARTLGELFGKPRYEAILHNAEAAKGQRKPQPLARVRKSGTGAKWQYDYYPTRTLILDEFKILWEAQKQYHPDLTHSAAYERLSDTIERQHPLKSPPVGKCTLIPTEPRAAKALSSSQCARILQEVNALRLMQTGKAQRSLSLEQRDLIANRLLHPTSKTAKVTFAQLKKLLGLSVYDSFSIETEKRKDLQGDETAAKLMQADRWGPSWFDLDLSTRDDIINELINVEDEEQLVTWLCKTHKLDRDQAYRVADCPLPAGYGNLSQLALAQILPPLFADVTVYSDAVQQAGLGSHSQFGTGEIFDKALPYYGRILDRSVAVTTGEVNDPDEKRYGKVANPTVHVALNQIRAVINDLMARFGAPEQIAIELARDLPLSAKGKSDLEKTQKANQDANDKRRRILDQQGIHDTYENRLRLRLFEDLEALGKRCPFSGEQISLTDLFSDKIEIEHILPFSRTFDDGYANKTLATRKANRDKKNQTPFEAFGHSPDGYNWEDISLRAAELPKNKSWRFGPDAMDRYTNFEGGFIARQLTDTQYISRLAKTYLESIHGGQGYKGAKNRVYVVTGRLTADLRHIWGLNSVLRGHNEPEAEAQRKNRHDHRHHALDAIVIACTDPALLKAAADKAKQNEHIYSGKLMAGLEEPWAGFRTDVEQSIRDIIVSHKPDHGIQAAMHNDTAYGIPKGEAGKADKKGVRTVVTRKPLDSDSFKSPGDLNKIRDDLIRNHLLEETYGLSGTDFKQALLLAAHAMTPPVYKVRIEEKLRVIPFKDASGKDYKAYKGDGNYCYDIWMSEKGKWTGEVISTYQAYQLARTDENWWQTLEGQDGQKLLMRLRKNDYLQIIHNDRQLIVQISQLTQGQIALAEHIEANVDARTRDKNDPLKFIFKSPGSLQKANTKYVTVSPSGVLNIHATGA

SEQ ID NO: 9192 - protein, 121 aa, unidentified
  REGION 1..121: note = Description of Unknown:uncultivated organism sequence
QIIYTANDGELAVNPVYAHASITREMKRLRESGSKAKVHCFVRSKCIFHLRKAVPQPEYKLVVKNEQKQKRRIPATLALAPAKFMLNTIITDSMDVEFSAANGQRLVAPLRVLIDAGFEPV

SEQ ID NO: 9193 - protein, 105 aa, unidentified
  REGION 1..105: note = Description of Unknown:uncultivated organism sequence
QWVYRDATGRSLVRPVYAFESAGQVRRELIAMHGLDALVGYFQSGCLVELVRPVAHKKTPLAPGQFSLNTLRKDGFAVVTDARGRKSEPISLKTLLESGFHRVTS

SEQ ID NO: 9194 - protein, 106 aa, unidentified
  REGION 1..106: note = Description of Unknown:uncultivated organism sequence
QILYFNEKGVVEVMPVYSNIKTTDVKDKLQNMGCKLYNKGQMFYSGCLVDIPKPFKAGSKEYPAGRYQIKTIRSDKVAELEDACGNKISTNVKYLVPAEFKKVESK

SEQ ID NO: 9195 - protein, 111 aa, unidentified
  REGION 1..111: note = Description of Unknown:uncultivated organism sequence
QFIWKDNKGNYLVAPVYIYSSKQKVYAELKNNPKCMGICDFFKTGCLVKISNEVVDEKKNRLWLKAGFYNLNSIAKEKRVYLTDVNGQEHKKIPLQHLMNAGMKRVETNTI

SEQ ID NO: 9196 - protein, 109 aa, unidentified
  REGION 1..109: note = Description of Unknown:uncultivated organism sequence
QVVWESVDGKYYVEPVYVHASKAGVMAALNANPKKKRICGMFNSHCTVDVGDVYNDRGDFILPAGRYMVNTILTTGRCVLTNADGEKRNPININYLMRAGMRRVELSEL

SEQ ID NO: 9197 - protein, 158 aa, unidentified
  REGION 1..158: note = Description of Unknown:uncultivated organism sequence
ELWIGWNAKKQVWEYQTRVVPTREAMAGIRRMGLPWRNTKNIPPYLQKILKQKKVSSLKELISGKLCPHSIHVADIRKGMVAKIEFEYDVKKCPSDKNGLKEVMWGEVTAILTSGKVECKSLIRKDMKPYSATNSLKIAMLFGFPPPDEFAKTHSLKP

SEQ ID NO: 9198 - protein, 166 aa, unidentified
  REGION 1..166: note = Description of Unknown:uncultivated organism sequence
ELWLGHDGKKWKYVTRVIPTKQALAGLKRMGLPWRGRERAPLYLIRLLDAARCRDLKQFICGTLPPHAVKVATVRKGDFFRATFNLKPKKREEQHSHTACLDTPATLTGWGKVTALMTKGQIGISPATHQGYEKTSVRGPSRLAKMLGLQEDAAAEAESRGLLPRP

SEQ ID NO: 9199 - protein, 104 aa, unidentified
  REGION 1..104: note = Description of Unknown:uncultivated organism sequence
QFVYLDARGRVRVRPVRPFESLVAVKAEVERLAAGGRLIGFFQSMCPVELDQPVTHGNFVLRPGTYRLNTIKKDGRAQVTTAAGEKTPQINLAKLVAAGFRRIA

SEQ ID NO: 9200 - protein, 107 aa, unidentified
  REGION 1..107: note = Description of Unknown:uncultivated organism sequence
YWLCKRGDAIEARPIRFFENPEQVRVRLLGQGWELLDPKPWRTGDLLNLPEAAQSGARSVPAGYYFLGSFSNDTGVNLKPCFGGEVPQNVSLKALWNRGLRRCSPTA

SEQ ID NO: 9201 - protein, 248 aa, unidentified
  REGION 1..248: note = Description of Unknown:uncultivated organism sequence
RAEIWVTEKPTKDGNAELNYHCRLIPHPRGLANLRQRVMQCTGKQLTWERRLTDEELRELGLLKELAALKREQEKISATHAKAVQKWQKEQQAKTNTLDLASSPSVQPIELKLPWLSLRKCYAGLPLYARRLTNKHGADISRIAKDDLLRVPLNSEGDICKREESAYQTLWYRVSAINKSGKIEMKMAERKQIKPPSERELRDGKRKPLTTDELWRVYAYTKEPSSTDVLAYLLEITRGNDQPPHPVK

SEQ ID NO: 9202 - protein, 122 aa, unidentified
  REGION 1..122: note = Description of Unknown:uncultivated organism sequence
QILYFNEKGSVKVMPIYANIKTQDVKDKLLALGCKLYNKGEMFYSGCLIEVEKPFNATVYYKETDENGKDKTISVKQEVPAGIFKLRTIMSNGAIKLENNCGMEILSSAKVLVEANMKKYKN

SEQ ID NO: 9203 - protein, 106 aa, unidentified
  REGION 1..106: note = Description of Unknown:uncultivated organism sequence
QILYFNQKGIVKVMPVYSNIKITDIKDKLQNMGCKLYNKGQMFYSGCLVDIPKPFKAGSKEHPAGCYKVRTITLGGQIKLEDNCGIEILTSATYLVQAGFKKVESK

SEQ ID NO: 9204 - protein, 122 aa, unidentified
  REGION 1..122: note = Description of Unknown:uncultivated organism sequence
QILYFDEKGLVKVMPIYSNIRTQDIKDKLMTMGCKLYNKGEIFYSGCLVEIEKPFVATVYYKETDTDGKEKTISVKQEVPDGIFKIRTIMGDGKIKLENNCGLEILSSAKVLVPLNMKKYKN

SEQ ID NO: 9205 - protein, 102 aa, unidentified
  REGION 1..102: note = Description of Unknown:uncultivated organism sequence
DVFKVENEGYYYVPIYVSDTVLPKLPNKACASSKPYEEWPEMREEDFIFSLYSRDLIYIKNKSPMNLHPTDGKRKHSNNRRNISVLHKGRYLRSNHKHNKQW

SEQ ID NO: 9206 - protein, 106 aa, unidentified
  REGION 1..106: note = Description of Unknown:uncultivated organism sequence
QILYYNEKGAIKVMPVYANQKLQEVKEKLLGMNCKLYKKGMMFTSGCLLEIPNEFYAGSNKYPAGIYKLRTIIADTCVIKIESSEGIEIVSSAKYLADAEFKKYKP

SEQ ID NO: 9207 - protein, 105 aa, unidentified
  REGION 1..105: note = Description of Unknown:uncultivated organism sequence
QILYFNEKGAIKVMPVYANKSTKEVRKQLEQMGCKLYNGGELFYSGCLIEVPNEFKGTKSNQKHGIYKLRTMMSDGKVKLENNSGEEIMTSANYLVNAKFSKYKD

SEQ ID NO: 9208 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLSEL

SEQ ID NO: 9209 - protein, 110 aa, unidentified
  REGION 1..110: note = Description of Unknown:uncultivated organism sequence
QFIWKTQKGKYMVAPVYAHASKAKVFAALKSNPDCAEVCGFFRQNCLVEISNDVIDKSGKMLLKAGVYRSNSVRSNGQVAITNSDGISPNPISIQYLMPAGMKRIKLDTV

SEQ ID NO: 9210 - protein, 110 aa, unidentified
  REGION 1..110: note = Description of Unknown:uncultivated organism sequence
QFIWKTKQGRYVVAPVYAHASKAKVLASLKNNPDCAEVCGFFRQNCLVEIPNDVVDKSGKMLLKSGIYKSNSIRADGYGYLENSDGISSKPISIQYLMPAGMKRIKLDII

SEQ ID NO: 9211 - protein, 110 aa, unidentified
  REGION 1..110: note = Description of Unknown:uncultivated organism sequence
QFIWKTQKGKYMVAPVYAYASKAKVFAALKSNPDCAEVCGFFRQNCLVEISNDVIDKSGKMLLKSGIYKSNTIMSDGRAKFTNSDGISTNPISIQYLMPAGMKRIKLDTV

SEQ ID NO: 9212 - protein, 110 aa, unidentified
  REGION 1..110: note = Description of Unknown:uncultivated organism sequence
QFIWKTKQGRYVVAPVYAHASKAKVLAALKNNPDCAEVCGFFRQNCLVEIPNDVVDKSGKMLLKSGIYKSNTIMSDGRAKFTNSDGISTNPISIQYLMPAGMKRIKLDTV

SEQ ID NO: 9213 - protein, 110 aa, unidentified
  REGION 1..110: note = Description of Unknown:uncultivated organism sequence
QIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRVSIKYK

SEQ ID NO: 9214 - protein, 109 aa, unidentified
  REGION 1..109: note = Description of Unknown:uncultivated organism sequence
QIVWESTDGKYYVVPIYVHASKAKLLAELDANPKKKRVCDIFTSHCMVKVGNAYNDKGELLLPEGVYMVNTIQTDGRGKLTNPNGEKSNLININYLMKAGMRKVSVKDL

SEQ ID NO: 9215 - protein, 109 aa, unidentified
  REGION 1..109: note = Description of Unknown:uncultivated organism sequence
QIVWESTDGKYCVLPIYVHASKAKLLAELCANPKKKRICGIFTSHCMVKVGNTYNNKGELLLPEGVYMLNTIRTDGWIQLTSANGDKSKPININYLMKAGMKKVPVKDL

SEQ ID NO: 9216 - protein, 110 aa, unidentified
  REGION 1..110: note = Description of Unknown:uncultivated organism sequence
QFIWKTQKGKYMVAPVYAHASKAKVFASLKNNPDCAEVCGFFRQNCLVEIPNDVIDKSGKMLLKAGVYRSNSVRSNGQVAITNSDGISPNPISIQYLMPAGMKRIKLDTV

SEQ ID NO: 9217 - protein, 109 aa, unidentified
  REGION 1..109: note = Description of Unknown:uncultivated organism sequence
QIVWESTDGKYYVVPIYVHASKAKLLAELDANPKKKRVCDIFTSHCMVKIGNTYNDKGELLLHEGVYMVNTIQTDGRGKLTNPNGEKSNLININYLMKAGMRKVSVKDL

SEQ ID NO: 9218 - protein, 109 aa, unidentified
  REGION 1..109: note = Description of Unknown:uncultivated organism sequence
QVIWESVDGKYYVGPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 9219 - protein, 110 aa, unidentified
  REGION 1..110: note = Description of Unknown:uncultivated organism sequence
QIIWMDKNGRYKVSPVYVHSSKSQTMESIKSNPDFIKIAGFFKSHCLVEIESPVVNGKRDVLLSPGTYMINTIMAAGMAILSDTNGVKSPAININYLMNAGMRRISIKYK

SEQ ID NO: 9220 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 9221 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTILTTGRCVLTNADGEKRNPININYLMRAGMRRVELSEL

SEQ ID NO: 9222 - protein, 110 aa, unidentified
  REGION 1..110: note = Description of Unknown:uncultivated organism sequence
QFIWKTKQGRYVVAPVYAHASKAKVLAALKNNPDCAEVCGFFRQNCLVEIPNDVVDKSGKMLLKAGVYRSNSIWASGHAQLTNSDGVSPNPISIQYLMPAGMKRIKLDTV

SEQ ID NO: 9223 - protein, 109 aa, unidentified
  REGION 1..109: note = Description of Unknown:uncultivated organism sequence
QIVWESTDGKYYVLPIYVHASKAKLLAELCANPKKKRICGIFTSHCMVKVGNTYNNKGELLLPEGVYMLNTIQTDGRGKLTNANGEKSNLININYLMKAGMKKVSIKEL

SEQ ID NO: 9224 - protein, 110 aa, unidentified
  REGION 1..110: note = Description of Unknown:uncultivated organism sequence
QIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRISIKYK

SEQ ID NO: 9225 - protein, 110 aa, unidentified
  REGION 1..110: note = Description of Unknown:uncultivated organism sequence
QFIWKTKQGRYVVAPVYAHASKAKVLAALKNNPDCAEVCGFFRQNCLVEIPNDVIDKSGKMLLKSGIYKSNTIMSDGRAKFTNSDGISTNPISIQYLMPAGMKRIKLDTV

SEQ ID NO: 9226 - protein, 109 aa, unidentified
  REGION 1..109: note = Description of Unknown:uncultivated organism sequence
QVIWESVDGKYYVEPVYVHASKAGVMAALNANPKKKRICGMFNSHCAVDVGDVYNDKGDFILPAGRYMVNTIRSDNQCVLTNADGEKRNPININYLMRAGMRRVDLSEL

SEQ ID NO: 9227 - protein, 109 aa, unidentified
  REGION 1..109: note = Description of Unknown:uncultivated organism sequence
QIVWESTDGKYYVLPIYVHASKAKLLAELCANPKKKRICGIFTSHCMVKVGNTYNNKGELLLPEGVYMVNTIRTDGWIQLTSANGDKSKPININYLMKAGMKKVLVKDL

SEQ ID NO: 9228 - protein, 110 aa, unidentified
  REGION 1..110: note = Description of Unknown:uncultivated organism sequence
QFIWKTKQGRYVVAPVYAHASKAKVLAALKNNPDCAEVCGFFRQNCLVEIPNDVIDKSGKMLLKAGVYRSNSVKSNGQVAITNSDGISPNPISIQYLMPAGMKRIKLDTV

SEQ ID NO: 9229 - protein, 110 aa, unidentified
  REGION 1..110: note = Description of Unknown:uncultivated organism sequence
QIIWMDKNGRYKVSPVYVHSSKSQTMESIKSNPDFIKIAGFFKSHCLVEIESPVVNGKGDVLLSPGTYMINTIMAAGMAILSDTNGVKSPAININYLMNAGMRRVSIKYK

SEQ ID NO: 9230 - protein, 109 aa, unidentified
  REGION 1..109: note = Description of Unknown:uncultivated organism sequence
QIVWESTDGKYYVVPIYVHASKAKLLAELDANPKKKRVCDIFTSHCMVKVGNAYNDKGELLLPEGVYMVNTIQTDGRGKLTNTNGDKSKPININYLMKAGMRKVSVKDL

SEQ ID NO: 9231 - protein, 110 aa, unidentified
  REGION 1..110: note = Description of Unknown:uncultivated organism sequence
QFVWKTKQGCYVVTPVYAFESKIKVWDDMRRDPNCEEICGFFRQNCLVEIPNDVYDSKGVLKLKAGVYRSNTIRADGFVKLTNSDGFSPNPISIQYLMSAGMKRITLNTI

SEQ ID NO: 9232 - protein, 110 aa, unidentified
  REGION 1..110: note = Description of Unknown:uncultivated organism sequence
QYIWKTKGGRYVVTPVYTFASKIRVYDDMRRDPNCEEICGFFRQNCLVEIPNDVYDSKGVWKLKAGIYRSNTIRADGFVKLTNSDGFSSNPISIQYLMTAGMKRITLDTI

SEQ ID NO: 9233 - protein, 109 aa, unidentified
  REGION 1..109: note = Description of Unknown:uncultivated organism sequence
QTVWRSTNGKCYVLPIYVHASKYGLIEALKKRADFKEIVGLFRMHCLVNIERDVFDKKGQKLLPPGIYMLNTLRADSQALLTNTDGVKQKAININYLVESGMRPIKVDY

SEQ ID NO: 9234 - protein, 109 aa, unidentified
  REGION 1..109: note = Description of Unknown:uncultivated organism sequence
QIVWESTDGKYYVLPIYVHASKAKLPAELCANPKKKRICGIFTSHCMVKVGNTYNNKGELLLPEGVYMLNTIRTDGWIQLTSANGDKSKPININYLMKAGMKKVPVKDL

SEQ ID NO: 9235 - protein, 110 aa, unidentified
  REGION 1..110: note = Description of Unknown:uncultivated organism sequence
QYIWKTKGGRYVVTPVYTFASKIRVYDDMRRDPNCEEICGFFRQNCLVEIPNDVYDNKGVLKLKAGIYRSNTIKTNGQVNLTTPNGIKFNGISIQYLMSAGMKRITLNTI

SEQ ID NO: 9236 - protein, 110 aa, unidentified
  REGION 1..110: note = Description of Unknown:uncultivated organism sequence
QIIWMDKNGRYKVSPVYVHSSKSQTMESIKSNPDFIKIAGFFKSHCLVEIESPVVNSKRDVLLSPGTYMINTIMAAGMAILSDTNGVKSPAININYLMNAGMRRISIKYK

SEQ ID NO: 9237 - protein, 109 aa, unidentified
  REGION 1..109: note = Description of Unknown:uncultivated organism sequence
QFIWKNKKGRYIVAPIYAHASKAKVLDDLQNNPDCAEICGFFRTNCLVKIPNDVADKDGKILLKAGFYKSNTIKTEGRVKLTNPNGIITEIGLQHLMNAGMKRVETNTI

SEQ ID NO: 9238 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGEFILPAGRYMVNTIRSDNQCVLTNADGEKRNPININYLMRAGMRRVDLSEL

SEQ ID NO: 9239 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVELSEL

SEQ ID NO: 9240 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTIQKNGQCVLTNADGEKRNPININYLMRAGMRRVDLSEL

SEQ ID NO: 9241 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTIRSDNQCVLTNADGEKRNPININYLMRTGMRRVDLSEL

SEQ ID NO: 9242 - protein, 109 aa, unidentified
  REGION 1..109: note = Description of Unknown:uncultivated organism sequence
QVIWESVDGKYYVGPVYVHASKAGVMAALNANPKKKRICGMFNSHCTVDVGDVYNDKGDFILPAGRYMVNTIQKNGQCVLTNADGEKRNPININYLMRAGMRRVELSEL

SEQ ID NO: 9243 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTIRSDNQCVLTNADGEKRNPININYLMRSGMRRVDLNEL

SEQ ID NO: 9244 - protein, 109 aa, unidentified
  REGION 1..109: note = Description of Unknown:uncultivated organism sequence
QVIWESVDGKYYVEPVYVHASKAGVMAALNANPKKKRICGIFNSHCTVDVGDVYNDKGDFILPAGRYMVNTIRSDNQCVLTNADGEKRNPININYLMRAGMRRVDLSEL

SEQ ID NO: 9245 - protein, 108 aa, unidentified
  REGION 1..108: note = Description of Unknown:uncultivated organism sequence
QVIWESVDGKYYVEPVYVHASKAGAMAALNANPKKKRICGMFNSHCTVDVGDVYNDNGDFILPAGRYMVNTIKKNGQCVLSDANNEKNTININYLMRAGMRRIELSEL

SEQ ID NO: 9246 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVGDVYNDKGDFILPAGRYMVNTIRSDNQCVLTNADGEKRNPININYLMRAGMRRVDLNEL

SEQ ID NO: 9247 - protein, 109 aa, unidentified
  REGION 1..109: note = Description of Unknown:uncultivated organism sequence
QIVWRSTNGKCYVMPIYVHASKYGLIEALKKRADFKEIVGLFRMHCLVNIERDVVNKNGQKLLPPGIYMLNTIMTKGTAVLTNTDGVKQKEVNMNYLVESGMRPIKVDY

SEQ ID NO: 9248 - protein, 109 aa, unidentified
  REGION 1..109: note = Description of Unknown:uncultivated organism sequence
QVIWESVDGKYYVEPVYVHASKAGVMAALNANPKKKRICGMFNSHCTVDVDDVYNDKGDFILPAGRYMVNTIRSDNQCVLTNADGEKRNPININYLMRAGMRRVDLSEL

SEQ ID NO: 9249 - protein, 109 aa, unidentified
  REGION 1..109: note = Description of Unknown:uncultivated organism sequence
QIIWKATSGKYKVEPIYAHASRTIVEKNLKQNSDFVEIAGFFKSGCLVQIENDVVNDEGLFLLPHGTYMLNTIKYTGQVKLTNCNGISGNAININYLMNAGMKRITINS

SEQ ID NO: 9250 - protein, 110 aa, unidentified
  REGION 1..110: note = Description of Unknown:uncultivated organism sequence
QIVWRDTKGKCRVCPVYVHASRFDVLEALKRRPDFSEIVGEFKSHCLVSIASDVFGKSGEKIMPAGTYMLNTIIYTGATVLTNPDGVKSKAVNINYLIDAGMKRKEGSRK

SEQ ID NO: 9251 - protein, 121 aa, unidentified
  REGION 1..121: note = Description of Unknown:uncultivated organism sequence
QIIYTDADGNLAVKPVYVHASIRQELTRIVQTGGKSKVHCFVRSKCLFRLRKELPQPDYRLVIKNEQKQKRRVQATAPLAPGTFMLNTIITASMDVEFSSAGNQRVVAPLQALLVAGFETI

SEQ ID NO: 9252 - protein, 106 aa, unidentified
  REGION 1..106: note = Description of Unknown:uncultivated organism sequence
QFVYLDAKGKPRVEVVRVFDSIAKVKAEIEARGKGIRVIGFYQSLCLVKLDKPVVHGTVTLEPGTYQLNTIKKDGQGRAQVTSAGGEKSLEISLGKFLAAGFTRAD

SEQ ID NO: 9253 - protein, 104 aa, unidentified
  REGION 1..104: note = Description of Unknown:uncultivated organism sequence
QFVYLDSKGKPHAEAVRVFDSVQRVKMAIEAKGKGVHIIGFFQSMCLVELEKPVVHGNITLQPGIYKLNTIKKDGRAQLTSAGGEKSPEIGLVKFLASGFKRVD

SEQ ID NO: 9254 - protein, 109 aa, unidentified
  REGION 1..109: note = Description of Unknown:uncultivated organism sequence
QIIWQTKSGKYKVAPIYVHASKRRILEALKNNPDFEKVAGEFRSHCLVKLDKPAVNDKGEELLADGIYMLNTIRTDGIAILTDPNGIKSPAIGINYLMQAGMRRIKMDY

SEQ ID NO: 9255 - protein, 105 aa, unidentified
  REGION 1..105: note = Description of Unknown:uncultivated organism sequence
QILYYNEKGSVKVMPVYSNKKTQEVKDKLEQMGCKLYNRGEMYYSGCLINVPNEFFAGKVTCPAGIYKVRTITEAGQIKLENNTGNEILSSAVNLSNAKFSKYKD

SEQ ID NO: 9256 - protein, 178 aa, unidentified
  REGION 1..178: note = Description of Unknown:uncultivated organism sequence
RREIWIGQRTKKKGRKTTVETFYKSRLIPHPRHLASYQKLHGQPWKADPLPLGMKLAGKLAVGDLLRIPLKKEKRNRNDNLIAKRGETPLESRFYRVKSMKTNGTIEFQMAEFAEPKLVKGQIPDPATERLLETYELTCSNEADLLWLLEVTTGKRIKLPPPVVENAPTTGKREGELL

SEQ ID NO: 9257 - protein, 129 aa, unidentified
  REGION 1..129: note = Description of Unknown:uncultivated organism sequence
ALVQPEPVIVPFHKVWVRLRDLKKVNSGTKPEIIRNGQIIRIAEGKYKGVWRVFSAKNNSTGMALDIGLPDVVRLKNKTEGHKINVLLSSLVKNGIEAIKAPLTGVPVSAGKGESHSSPLEPRQSSNAS

SEQ ID NO: 9258 - protein, 112 aa, unidentified
  REGION 1..112: note = Description of Unknown:uncultivated organism sequence
ALDPQPTIIPFHKVWPRLQELKKANGGKLPRVLRNGQIIYIPKGTYSGVWKVFSAKNNKSGMALDMGRPDVVRLRNKTDGHKINVLLSSLLKDGMTIVDAPLTGVSSAPKQS

SEQ ID NO: 9259 - protein, 112 aa, unidentified
  REGION 1..112: note = Description of Unknown:uncultivated organism sequence
ALDPSPTVIPHFKVYPQLRALREKNGGRPIRILRKGSLIQVKAGTYQGIWSVASIKDNADGICLDINAADKVKLENRSDDSKINVRLDSLRKSGLKILKPKLTGACPTTSSP

SEQ ID NO: 9260 - protein, 105 aa, unidentified
  REGION 1..105: note = Description of Unknown:uncultivated organism sequence
ALLASGPVVIPYIGVWKRIKELTQMNNGVRPEILRNGSIVEIPKQEGKPYKYEGRWLVRGIDNSAQGMRIKFDTVDGVGGIAFKSFINPLLKRGMRILSADLSGE

SEQ ID NO: 9261 - protein, 110 aa, unidentified
  REGION 1..110: note = Description of Unknown:uncultivated organism sequence
ALDPEPTIIPFHKVWPRLQELKKANGGKWPRVLRNGHLIHVPKGRYQGTWRVFSAKNNKSGMAVDMGWPDVVRLRNGVQGHKINVLLASLLRDGMTILDTPLTGVASPVR

SEQ ID NO: 9262 - protein, 110 aa, unidentified
  REGION 1..110: note = Description of Unknown:uncultivated organism sequence
ALDPEPTIIPFHKVWPRLQALKKANGGKWPRVLRSGQLIHVPKGRYQGTWRVFSTKNNKSGMAVDMGWADVVRLRNGVEGHKINVLLASLLRDGMTILDTPLTGVASPPL

SEQ ID NO: 9263 - protein, 85 aa, unidentified
  REGION 1..85: note = Description of Unknown:uncultivated organism sequence
TLGPKMEVIPHHQVQERWKGLGCPRYLRNGQIIEMPTGKYSGAWKVFSIKNARQGILLDIARADSPRAKQGNPGTRINVLLKTLV

SEQ ID NO: 9264 - protein, 113 aa, unidentified
  REGION 1..113: note = Description of Unknown:uncultivated organism sequence
AILENTSLPSGDRFVIIPHVRVWKQLQELRMRNGGKPPEVWRKGQIVRIPSGNREGKWRIFSVMASNRGIMLKLDRPDSPSFDDSGGASGFKMTLTSLIKRGTIRLETRLTGS

SEQ ID NO: 9265 - protein, 115 aa, unidentified
  REGION 1..115: note = Description of Unknown:uncultivated organism sequence
ALTQSTPEIITWHKVYPKLSSIYKRDGVWPNVLRNGMLISVFSGRYAGIWRILSIKNNATGINFSIAKPDAIAPFKQNVLLKSLMSAGLKKVETKLTGDGICHITSSKSIAPLFD

SEQ ID NO: 9266 - protein, 102 aa, unidentified
  REGION 1..102: note = Description of Unknown:uncultivated organism sequence
ALANPPQIIPHHNVWQRLSELAEKNGGRFPKILRRNQIIEIPSGRYKGIWRITSIKNNSNYIGVDMIHPIYVRIKEKSKINVNLNTIIKDGMKIIDTRLIGA

SEQ ID NO: 9267 - protein, 102 aa, unidentified
  REGION 1..102: note = Description of Unknown:uncultivated organism sequence
ALANPPQIIPHHNVWQRLSELAEKNGGRFPKILRRNQIIEIPSGRYKGIWRITSIKNNSNYIGVDMIHPIYARIKEKSKINVNLNTIIKDGMKIIDTRLIGA

SEQ ID NO: 9268 - protein, 104 aa, unidentified
  REGION 1..104: note = Description of Unknown:uncultivated organism sequence
ALTTPPKIIPRHKVWQRLGKLAAENGGKFPIVLRKNQIIDVACGRYAGRWRITSIKNNAGYIGIDMIPPIYASGAKNRLKVNVNLNTLVRDGMSIKSGCLTGAC

SEQ ID NO: 9269 - protein, 125 aa, unidentified
  REGION 1..125: note = Description of Unknown:uncultivated organism sequence
ALDPTPTVIHFHKVWSRLRELKKVNGGKMPRVLRNGHLIRVSEGSRAGLWRVTSIKQTEAYGLALDLAYPDSVGLSRPNAPILQLQAEGLAIVGTSLTGFDASAVMYAAIKRRPRKLKTEQSESS

SEQ ID NO: 9270 - protein, 114 aa, unidentified
  REGION 1..114: note = Description of Unknown:uncultivated organism sequence
ALDPLPTIIPFHKVWPRLQELKKANGGKLPRVLRNGQTIKVPEGKYKGVWRIFSAKNNATGMAIDIGQPDVVRLKNKTEGHKINVLLTSLLKNKMEVVKTPFTGISAIPATSST

SEQ ID NO: 9271 - protein, 108 aa, unidentified
  REGION 1..108: note = Description of Unknown:uncultivated organism sequence
ALDPQPIVIPFHKVWTRLQELKKANAGKLPRVLRNGQLIRVKDGTYKGVWRVFSAKNNATGMALDIGSPDVVRLKNKTEGHKINVLLSSLIKGGLEPIQSSFTGITSK

SEQ ID NO: 9272 - protein, 113 aa, unidentified
  REGION 1..113: note = Description of Unknown:uncultivated organism sequence
ALDPAPPTVIPHFKVYPQLRALREKNGGRPVRILRKGSLIQIKTGRFQGIWSVASIKDNADGICLDINAADKIKIENGSVDSKINVRLNSLLNSGLKILKPKLTGTCPTTSSP

SEQ ID NO: 9273 - protein, 107 aa, unidentified
  REGION 1..107: note = Description of Unknown:uncultivated organism sequence
ALDPKPEIIPFAQVWRRLAELRAENDGKPVRVLRKGSLFRVGQGKFAGEFKVFSIKKNHNGLSLDIGPRDIPRPLNKMTAQGHYINVLLSSLLKGGLEIMDTDYAMN

SEQ ID NO: 9274 - protein, 107 aa, unidentified
  REGION 1..107: note = Description of Unknown:uncultivated organism sequence
ALDPEPKVIPYQQVWAQLQQLKKQNGGRTVRVLRNGHIIRVQKGRYRGLWRVHSIKDANMGLVLDIASPELVRVSNGVVGAKLNVRLKTLLSNGLELLNLDSSSHEV

SEQ ID NO: 9275 - protein, 118 aa, unidentified
  REGION 1..118: note = Description of Unknown:uncultivated organism sequence
ALDPQPTVIPFHKVWTRLQELKKANGNKMPRILRNGQLIRIVRGSRAGIWKVLSTKDTKAYGIALDLALPDRVKLDRGNAPIKTLIQDGLEILDCSFVGIDSSKITITEAKKRPRKPK

SEQ ID NO: 9276 - protein, 113 aa, unidentified
  REGION 1..113: note = Description of Unknown:uncultivated organism sequence
ALDPEPTLIRPHKVWHKLHDLREKNGGKPVRVLRIGSLIRVLEKGKQSDYRGVRMIRGVQLNQKSGFLVDLSPADQILYRGQPGCFQQVSVATLLKCGLEILKAPLCGVTPSE

SEQ ID NO: 9277 - protein, 126 aa, unidentified
  REGION 1..126: note = Description of Unknown:uncultivated organism sequence
AILDHAPEGEEKFVVIPWHRVWHRLNELKARNGGEAPRVLRNGQVVSITSGTYAGRWRVFSIKAKQAGIKVNLGTLDCLGVEEDYLDPATGKKRTRTVAGCKLDAALPTMVKGGLKVLKPRFCGTP

SEQ ID NO: 9278 - protein, 124 aa, unidentified
  REGION 1..124: note = Description of Unknown:uncultivated organism sequence
ALDPEPQVIRFHKVWPQLQELRRKNGGKPVRVLRNGQLIRVPRGRYQGVWRVMSAKANLKLDLAWADATKMKSSGIDVRGNVLVSTLFRDGMEILDCPYIGVAACPTTPAASEPKPNRHGTGWS

SEQ ID NO: 9279 - protein, 122 aa, unidentified
  REGION 1..122: note = Description of Unknown:uncultivated organism sequence
AILDHVSSPDERFVIIPWYRVWHQINELREKNQGKPPRVLRIGSVVRVTAKSGRADYRGLWMIRGAQLNQRQGFLVDISAPDVITYRVSGRSDCFQNVRLKALVDGGLEILKPTLAGLPLKT

SEQ ID NO: 9280 - protein, 111 aa, unidentified
  REGION 1..111: note = Description of Unknown:uncultivated organism sequence
ALDPEPRIIRFHKVWHQLQVLRRANGGTPVRVLRTGQLIRVPTGRYAGLWRVFSVKAALTLNLGAPDKVRLESKGPGVKRDVRLKTLLHDGLQLLEPPYTGIAACPTTSST

SEQ ID NO: 9281 - protein, 124 aa, unidentified
  REGION 1..124: note = Description of Unknown:uncultivated organism sequence
ALDPEPTIIRFHKVWHQLQALRHQNHDKPIRVLRKGQIIQIHNGTRAGIWRVFSVKDTEAYGVAVDLSLLDNPGLNRGNAPVEKLLIDGLSIINCPLVGIDSSKIQMAPVKKRLRKSKKNTANE

SEQ ID NO: 9282 - protein, 109 aa, unidentified
  REGION 1..109: note = Description of Unknown:uncultivated organism sequence
AILDDEKLPPEDRFVIIPFAHVWKRVAELKTRNGGKRPQIWRNGQIIELKKGKRAGLWRIFSIKNNTSGMALDLGPIDAVKPIWINCLLKSLLRDGARRLNTTFSGADI

SEQ ID NO: 9283 - protein, 112 aa, unidentified
  REGION 1..112: note = Description of Unknown:uncultivated organism sequence
AILDNPEIPPAERLVIIPFARVWAQLGALKQRNGGKPPLIWRNGQVLKIPAGPRAGLWRIFSIKNNASGMALDLGTVETVRPSWINVLLKSLLRDGALRLNTDLTGRAFPQD

SEQ ID NO: 9284 - protein, 113 aa, unidentified
  REGION 1..113: note = Description of Unknown:uncultivated organism sequence
AILDDEKLPPAERFVVIPFARVWEQLETLKARNGGRSPQVWRNGQVIKLPKGPRAGHWRIFSIKNTSNMGLVLDLGTVEAIRPTWINVLLKTLLRNGASRAITTLAGSEARNA

SEQ ID NO: 9285 - protein, 111 aa, unidentified
  REGION 1..111: note = Description of Unknown:uncultivated organism sequence
ALTQPKPVIVPFHKVHKRLEELKHSNAGKMPQVIRAGALVQIPKGTHNGSWRVFSIKNNANGVAFALGQRDALHPDPSKQNVLVRQLEKDGMVVQGTALTGIPVCPTTSSA

SEQ ID NO: 9286 - protein, 116 aa, unidentified
  REGION 1..116: note = Description of Unknown:uncultivated organism sequence
ALTNPDPVIVPFHKVWPRLSELKARNGGKVPRILRNGQLIRVPGGKKFKGVWRVFSAKNNAKGIALDIGSPDVVRLKNKTEGHKINVRLATLIKDGMEVLKTPLTGLAACPAASSG

SEQ ID NO: 9287 - protein, 108 aa, unidentified
  REGION 1..108: note = Description of Unknown:uncultivated organism sequence
ALDPQPTVIPFHKVWIRLQELKNANGGKMPRVLRNGQLIRVKEGKFKGVWRVFSAKNNATGMALDIGSPDVVRLKNKTEGHKINVRLSSLIKCGLEPVRASFTGVASK

SEQ ID NO: 9288 - protein, 116 aa, unidentified
  REGION 1..116: note = Description of Unknown:uncultivated organism sequence
ALVEPEPVIIPFHKVWPRLSELRAANGGRMPMVLRNGQLIRVPGGKSFKGVWRVFATKNNASGMALDIGSPDVVRLKNKTEGHKINVRLATLIRDGMEVLRTPLTGFAACPAPSSP

SEQ ID NO: 9289 - protein, 108 aa, unidentified
  REGION 1..108: note = Description of Unknown:uncultivated organism sequence
ALDPQPTVIPFHKVWTRLQELKKANGGKMPRVLRNGQLIRVKDGTYKGVWRVFSAKNNATGMALDIGSPDIVRLKNKTEGHKINVLLSSLIKGGLDPLHTPFTGVNPK

SEQ ID NO: 9290 - protein, 116 aa, unidentified
  REGION 1..116: note = Description of Unknown:uncultivated organism sequence
ALTKPQPVIVPFHKVWPRLSELKAANGGRMPTILRKGQLIRVPCGKNFKGVWRVFSAKNNASGMALDIGSPDVVRLKNKTEGHRINVRLATLIKDGMEVLKTPLTGVAACPAMSSA

SEQ ID NO: 9291 - protein, 116 aa, unidentified
  REGION 1..116: note = Description of Unknown:uncultivated organism sequence
AYLNQSDDPGSPFVIIPHHKVWHRLKELKIRNHGKRPIILRKGDIIEFKKGDQLLRYRIFGAGQRARGLYLDAAFLDELDRSVELYPATLLRGSFRLVQTSLTGAERKSCPTTSSA

SEQ ID NO: 9292 - protein, 108 aa, unidentified
  REGION 1..108: note = Description of Unknown:uncultivated organism sequence
ALDPQPTVIPFHKVWTRLQDLKKANGGKMPRVIRNGQLIRVTEGKYKGVWRVFSAKNNAAGMALDIGAPDVVRLKNKTESHKINVLLSSLTKSGLEPFHASFTGVSSK

SEQ ID NO: 9293 - protein, 116 aa, unidentified
  REGION 1..116: note = Description of Unknown:uncultivated organism sequence
AFLHRNAESADRFVVIPHHKVWHRIEELRTRNQGKRPIILRKGDIIEFKKDDQFVRYRIFGAGQRARGLYFDAALLDELDRSVELHPTTLIRGNFRLVETSLTGVERKSCSITSSA

SEQ ID NO: 9294 - protein, 114 aa, unidentified
  REGION 1..114: note = Description of Unknown:uncultivated organism sequence
ALDPEPTLIRPHKVWHQLAALRQRNGGKTPRLLRIGTIIRVTEKGPRSDYRGTWMVRGMSFKQRDGLVLEIAPPDYVQSRRVPGVFESASVTTLLKCGLEVLKAPLCGVATILA

SEQ ID NO: 9295 - protein, 118 aa, unidentified
  REGION 1..118: note = Description of Unknown:uncultivated organism sequence
VILPPIEVGGEKQWRDGKEIIVLPFFQVHKSLGLLKAENKGKEIQLLRNGTLIQVPKGERQGWWRIISVKDTEAYGIAVDLANPDGVEKAKGNAPVSVLLADGMKIISSTLTGHDIRK

SEQ ID NO: 9296 - protein, 150 aa, unidentified
  REGION 1..150: note = Description of Unknown:uncultivated organism sequence
AILDNNAEHKFQIIPWFKVWPRLYKGIGDEKSLVEQNAGKMPRILRNGMLIRIGKFRILKPTRILENSIWSVDSIGDFDGVIKVDLKQCDTVNTRFDGIDPTDPTGKKKKKFTSPGCKLSTDLERVYEGGLEILKTPLTGIASCPITSSA

SEQ ID NO: 9297 - protein, 139 aa, unidentified
  REGION 1..139: note = Description of Unknown:uncultivated organism sequence
AILDHAPEGEDKFVIVPWHKIWVRIYKGFKDEAGKTIEKSLVERNGGKQPRILRIGTLIRVSNPKNKAYKGIWMVRGVQLNQRAGYLVDISEPDVIEYRVPKRKDCKQNVGLKALVQGGLEILKTPLTGVVSPPLKLAE

SEQ ID NO: 9298 - protein, 115 aa, unidentified
  REGION 1..115: note = Description of Unknown:uncultivated organism sequence
ALDPQPTIIPFHKVWTRMQELKAANFGKKPRVLRNGQLIRVPNGKNFKGIWKVFSAKNNASGMAVDIGFPDVVRLKNKTEGHKINVRLATLIKDGLEILKTPLTGIAAYPIPSSA

SEQ ID NO: 9299 - protein, 108 aa, unidentified
  REGION 1..108: note = Description of Unknown:uncultivated organism sequence
ALDPQPAIIPFHKVWPRLQELKKANGGKMPRILRNGQLIRVKEGNFKGLWRVFSAKNNATGMALDIGSPDVVRLKNKTEGHKINVRLASLLKGGLEPIRSPLSGISSK

SEQ ID NO: 9300 - protein, 127 aa, unidentified
  REGION 1..127: note = Description of Unknown:uncultivated organism sequence
ALDPQPTLIRPHKVWPQLQSLRSANGGKPVRVLRKGILVRVPKRGIRPKYEGVWMVRGVTLNQRAGFLVDMSPSDQIIYRRHPGCLENVSVATLLRCGLEVLRAPLSGVPPLPKQAEGYDVPGISDC

SEQ ID NO: 9301 - protein, 122 aa, unidentified
  REGION 1..122: note = Description of Unknown:uncultivated organism sequence
GLDPHPTIIPFHKVWTRLKELKSSNGGKTPRVLRNGQIIQVPNGKNFKGIWKVFSAKNNASGMALDIGSPDVVRLKNKTEGHKINVRLATLMKDGLEIQKCGLTGVPACPTTSSALIPPTAP

SEQ ID NO: 9302 - protein, 132 aa, unidentified
  REGION 1..132: note = Description of Unknown:uncultivated organism sequence
ALDPEPTLIRPHKVWHQLETLRQRNAGKIPRLLRIGTIIRVKEKSPRSDYRGTWMVRGMSFKQRDGLVLEIAPADYVPSRRVQGVFESASVATIMKCKLEVVKVPLCGVAPSPELASHIISETKACPTTSSV

SEQ ID NO: 9303 - protein, 112 aa, unidentified
  REGION 1..112: note = Description of Unknown:uncultivated organism sequence
ALDPEPTLIRPHKVWHQLEALRRRNGGKTARLLRLGTLIRVETKAARSDYRGTWMVRGMSFKQRDGLVLEIAPPDYVRSRRVPGVFESASVATLLKCGLEIIKPPLCGVAPG

SEQ ID NO: 9304 - protein, 115 aa, unidentified
  REGION 1..115: note = Description of Unknown:uncultivated organism sequence
ALDPQPTIIPFHKVWTRMQELRAANFGKKPRVLRNGQLIRVPNGKNFKGIWKVFSAKNNASGMAVDIGFPDVVRLKNKTEGHKINVRLATLIKDGLEILKTPLTGIAAYPIPSSA

SEQ ID NO: 9305 - protein, 109 aa, unidentified
  REGION 1..109: note = Description of Unknown:uncultivated organism sequence
AILDDDKLAPAERFVIIPFARVWQQLQALTERNGGKPPQVWRNGQIIELPSGPRAGRWRIFSIKNTTKMGLVLDLGAVDAIKPNWINVILKSLFRIGTRRVGSSLTGKI

SEQ ID NO: 9306 - protein, 127 aa, unidentified
  REGION 1..127: note = Description of Unknown:uncultivated organism sequence
AILDHAASTEDRVVIVPHHKVWHRLNDLRIRNRGHWPRVLRPGSLVRLRNTKPAGKRDGIWRVYTAQASLKIDLVWADSVERKKKGTDVWREVSIANLGLHNIEVLPRRLSGFPQHGSVRCPTISSA

SEQ ID NO: 9307 - protein, 116 aa, unidentified
  REGION 1..116: note = Description of Unknown:uncultivated organism sequence
VIFPPIEVNGEKQWRDGKEIIVLPFFRVHHSLEQLKAQGKKIQLLRNGALIHVPKGDRYGWWRVISVKDTEAYGKAVDLAAPDGVEKIKGNAPLTVLLKEGMKIISSPLTGHDIRR

SEQ ID NO: 9308 - protein, 111 aa, unidentified
  REGION 1..111: note = Description of Unknown:uncultivated organism sequence
ALDPVPTVIPFHKVWPRLQELKAKNSGKMPRVLRNGQLIQVPSGAFKGTWKVFSAKNNKTGMALDIGHPDVVRLKNKTDGHKINVLLSTLLKNGIIGLNTPLTGVAATDTT

SEQ ID NO: 9309 - protein, 122 aa, unidentified
  REGION 1..122: note = Description of Unknown:uncultivated organism sequence
ALDPEPTLLRPLHVWRQMTALKAANGGKWPRVLRNGMLIRVPRAKTAKVDYRGTWMLRGVQVNQAKGFLVDLSPTDQIRYRGEDGCFQNVSLETLLKCGLEILKPTLCGVAQASSVPTTSVG

SEQ ID NO: 9310 - protein, 117 aa, unidentified
  REGION 1..117: note = Description of Unknown:uncultivated organism sequence
ALTSPPQIITWHKVFPKLKEIEQETGTWPQVLRNGMLICVPEGNYAKVSKVWKIFSLKNNASGMAVDMGYADSIKPFKINVLLKSLIKDGLRLVESNFSGEGICHITSSILAVQPSD

SEQ ID NO: 9311 - protein, 107 aa, unidentified
  REGION 1..107: note = Description of Unknown:uncultivated organism sequence
ALDPEPKVIPYQQVWGQIQHLRKQNGGRPIRVLRNGNIIRVKEGRYAGLWRVHSIKDANMGLVLDIASPELVRAGNGVVGAKMNVRLNTLLSNGLELLNLDSSSHEF

SEQ ID NO: 9312 - protein, 111 aa, unidentified
  REGION 1..111: note = Description of Unknown:uncultivated organism sequence
ALEPQPTIVPFHKVWMRLKALRKANNGKMPRVLRNGQIIQVPTGRYKGIWRLFSAKATLTLDLGTPDKVRLESKGDGQKREVQIKTLIKDGMLVRKTPLTGIAAHLTAPSS

SEQ ID NO: 9313 - protein, 113 aa, unidentified
  REGION 1..113: note = Description of Unknown:uncultivated organism sequence
ALDPEPALIRPHKIWHQLAALRARNGGKPPRVLRIGSLIRVNQKTGRSDYRGTWRVRGIQLSQRSGCLVDLSPPDQILYRGQPGSFQNVSVATLLKCGLEILKTPLSGVAAPP

SEQ ID NO: 9314 - protein, 113 aa, unidentified
  REGION 1..113: note = Description of Unknown:uncultivated organism sequence
ALDPEPALIRPHKIWHQLAALRARNGGKPPRVLRKGTLIRVNQKAARSDYRGIWRVRGVQLNQRSGYLVDLSPPDQIHYVRQPGSFQNVSVATLLKCGLEILKTPLSGVAAPR

SEQ ID NO: 9315 - protein, 113 aa, unidentified
  REGION 1..113: note = Description of Unknown:uncultivated organism sequence
ALDPEPALIRPHKIWHQLAALRARNGGKPPRVLRIGSLIRVNQKTGRSDYRGTWRVRGVHLNQRAGYLVNLSPPDQIRYVGQDGCFQNVSVATLLKCGLEILKTPLSGVAAPP

SEQ ID NO: 9316 - protein, 114 aa, unidentified
  REGION 1..114: note = Description of Unknown:uncultivated organism sequence
ALDPEPTIIPFHKVWERLRELKKANGGKRPRVLRNGQLVKVPQGKFMGVWRVFSVKNNTSGIAVDLGFPDVVRLKNKMAGHKINVLLASLLKNGMRVVKPPLTGVPTWPTTSSA

SEQ ID NO: 9317 - protein, 113 aa, unidentified
  REGION 1..113: note = Description of Unknown:uncultivated organism sequence
ALDPEPALIRPHKIWHQLAALRARNGGKPPRVLRKGTLIRVNQKAARSDYRGIWRVRGVQLNQRSGYLVDLSPPDQIHYVKQPGSFQNVSVATLLKCGLEILKTPLSGVAAPR

SEQ ID NO: 9318 - protein, 113 aa, unidentified
  REGION 1..113: note = Description of Unknown:uncultivated organism sequence
ALDPEPTLIRPHKVWHQLNALRLRNGGKPPRLLRIGSLVQVRQKTPRSDYRGVWMVRGVQLDQRAGYLLDLSPADQILYRGQPGCFRNVSVATLLKCGLDILKVPLTGVAPAQ

SEQ ID NO: 9319 - protein, 113 aa, unidentified
  REGION 1..113: note = Description of Unknown:uncultivated organism sequence
ALDPEPALIRPHKIWHQLAALRARNGGKPPRVLRKGTLIRVNQKSARSDYRGTWRVRGVQLNQRAGYLVDLSPPDQIHYVRQRGSFRNVSVATLLKCGLEILKTPLSGVAAPP

SEQ ID NO: 9320 - protein, 125 aa, unidentified
  REGION 1..125: note = Description of Unknown:uncultivated organism sequence
AILDHALGGEEFAVIPWHRVWHRLQALKAMNGGEPPRILRNGMLIKVAAGTYQGLWRVISAKDTQAYGKVVDLALPDGQALERGNAPLRKLLVDGLEILAQKSFVGHSTAGVAYAAKRTRKTKSP

SEQ ID NO: 9321 - protein, 113 aa, unidentified
  REGION 1..113: note = Description of Unknown:uncultivated organism sequence
ALDPEPALIRPHKIWHQLAALRARNGGKPPRVLRIGSLIRVNQKTGRSDYRGTWRVRGVHLNQRAGYLVNLSPPDQIRYVGQDGRFQNVSVATLLKCGLEILKTPLSGVAAPP

SEQ ID NO: 9322 - protein, 114 aa, unidentified
  REGION 1..114: note = Description of Unknown:uncultivated organism sequence
ALDPEPTIIPFHKVWERLRELKKADGGKRPRVLRNGQLVKVPQGKFMGIWRVFSVKNNTSGIAVDLGFPDVVRLKNKMAGHKINVLLASLLKNGMRVVKPPLTGVPTWPTTSSA

SEQ ID NO: 9323 - protein, 191 aa, unidentified
  REGION 1..191: note = Description of Unknown:uncultivated organism sequence
RLLTWDDPKKGPQLGIQRVFAAEFGEILKDASSNDLFEAPIPFHTMSHRDLQPKVRAAVEQGLTRQIGWITQGDELEIDPADFVGEANAFGNFLREFPERSWSIAGLKKSNTIVIRPLLLSQEGVTAAISPHAAKIVENGIELSNSTLFTAPGTGIIRRTGLGRPRWDSGPAHLPESFNVHARMTQQSARD

SEQ ID NO: 9324 - protein, 202 aa, unidentified
  REGION 1..202: note = Description of Unknown:uncultivated organism sequence
RVYAWMGAKGQLEYGMMRVFGAEFPTLTKLSGSKDILRMPIHAGSMSYRDMQDRVRKPIESDIAVELGWITQGDELEILPEAHLETAGGLGDFLKSFPETQWTIDGFNDPSRLRVRPRLMSLEGRDTIDAMGHLSDTEKLKIKQALSKGLMVSASELLSHGAKIIRRDHLGRPRWRGNARPVSIELEQVANQLVNHRSVDGQ

SEQ ID NO: 9325 - protein, 202 aa, unidentified
  REGION 1..202: note = Description of Unknown:uncultivated organism sequence
RLYGWKNQRGDIQVGMLRVFGAEFPWFMRESGVKDILRVPIPQGSQSYRDLAATTRKFIENGQATEFGWITQNDEIEISAEEYLATDKGDILSDFLGILPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 9326 - protein, 205 aa, unidentified
  REGION 1..205: note = Description of Unknown:uncultivated organism sequence
RLYSWLTKKGELKFGMLRVYGAEFPWLMRESGSRDVLHMPIHPGSQSFRGMQDGVRKAVESGEAVEFGWITQDDELEFDPEDYIAHGGDDELNRLLRVMPERRWRVDGFYNAGTLRIRPALLSAEQLPSELQKKVADKTLSDVELILLRAVQRGLFVAISSFLPLESLKVIRRNNLGFPRWRGNGNLPTSFEVRSSALRALGVEG

SEQ ID NO: 9327 - protein, 205 aa, unidentified
  REGION 1..205: note = Description of Unknown:uncultivated organism sequence
RLYSWLTKKGELKIGMLRVYGAEFPWLMRESGSHDVLRMPIHPGSQSFRDMQDTTRKAVESSEAVEFAWITQNDELEFEPEDYIAHGGKDELRQFLEFMPECRWRVDGFKKNYQIRIRPAMLSREQLPSDIQRRLESKTLTENESLLLKALDTGLVVAIGGLLPLGTLKVIRRNNLGFPRWRGNGNLPTSFEVRSSALRALGVEG

SEQ ID NO: 9328 - protein, 205 aa, unidentified
  REGION 1..205: note = Description of Unknown:uncultivated organism sequence
RLYGWLTKKGELKVGMLRVYGAEFPWLMRESGSRNVLSMPIHRGSQSFRDMQDTTRKAVESGEAVEFAWITQNDELEFDPDDYIAHGGKDELRQFLGFMPECRWRVDGFKKNYQIRIRPAMLSREQLPSDIQRRLESKTLTKNESLLLKALDTGLVVAIGGLLPLETLKVIRRNNLGFPRWRGNGNLPTSFEVRSSALRALGVEG

SEQ ID NO: 9329 - protein, 198 aa, unidentified
  REGION 1..198: note = Description of Unknown:uncultivated organism sequence
RLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALDEQE

SEQ ID NO: 9330 - protein, 128 aa, unidentified
  REGION 1..128: note = Description of Unknown:uncultivated organism sequence
EILAVRDPAGAVTHWEGELVSLFEAARRVKAGEPVVRRNHGPNKDFLFSLAKGEYVEMELQPGKRQLFRVTVISAKQIEFRLHHDARPTMLLRKTPGARVIRSPGSLFKAKARKVAVDPLGNVFPAND

SEQ ID NO: 9331 - protein, 126 aa, unidentified
  REGION 1..126: note = Description of Unknown:uncultivated organism sequence
EVVEGKDGRWEAVTVPRMEVYQRCRAKRPIVNRNHGDKWYVCSLAIGDYFTVDGGEKKLYVVKMLSGQVVGYMEHNDGRLQKTSGDDMSVFRTSINKLRQKGFRKVQLDVMGRLAVGKERCPTPQF

SEQ ID NO: 9332 - protein, 152 aa, unidentified
  REGION 1..152: note = Description of Unknown:uncultivated organism sequence
EFYAVLDDKGNEIEWKFNIVSLYEAYERRRKHLPIVSRDFGPKTRFKFSLVKGDAIREKATGKIYFIAGLSTQGEGKGIYITGALNTCAKPVTVIKEEYSKMSKMKRGVAQGDMKGLPKEVAYFRSTNLVDLMKRFEKVRIDPLGNVERSNS

SEQ ID NO: 9333 - protein, 127 aa, unidentified
  REGION 1..127: note = Description of Unknown:uncultivated organism sequence
EIYALLDGQGQEVRWKGKIVSLYEAYERKKRGEPVVCRDHGPNTRFKFSLAKSEYIEWINDDGQKQLLRVVGISDDNLELRLPHDARPITLIREQRERIRATYRQLFQRRARKVMVTPLGEVLPAND

SEQ ID NO: 9334 - protein, 136 aa, unidentified
  REGION 1..136: note = Description of Unknown:uncultivated organism sequence
AIFALLDERGGERRWEPMIVSLFEAMERKRKGQPLIQTRYPVVGEFIFKFSLMGGDTVLLHKDCDHKNNHCNPSVWRLRTIGSNGQLSLVRINDARLKAEIQKAKEWWSPTQDALRKLDAVKVVIDSLGRIHQSGG

SEQ ID NO: 9335 - protein, 120 aa, unidentified
  REGION 1..120: note = Description of Unknown:uncultivated organism sequence
EIYEVEENGRRVWRGDVVSMREAIERATRGEPVTRRRGGAGVRYLFSVSKEDTLRLHGKYEGLWVVKKIAQKGQITLVSQFDARSEQNRTVFSPRVGGLQGYSAEKVVVLPIGDVVPCNE

SEQ ID NO: 9336 - protein, 124 aa, unidentified
  REGION 1..124: note = Description of Unknown:uncultivated organism sequence
AVFEVTKRSRQGTRTAWEGEVVSLWEALERLRLGKPVIDRAGGPDRRFLFSLCKNDTLQLNGPRPGIYVVRKIRQNKQITLVPQHDARPEKQREQFSPTVSGLLEYAARKVVVTPLGELVESHE

SEQ ID NO: 9337 - protein, 127 aa, unidentified
  REGION 1..127: note = Description of Unknown:uncultivated organism sequence
EIIEEKDKKGNPRWTAIVVSRFEAMQRKIRGEPIVQREHGEGRRFVCSIASGDTFSYREKEDGPGIFARVRSIWKQNVEFVQINDARLKAEIKKENEWYVRSVNELRKMGFQKVSVSPIGEVYPAND

SEQ ID NO: 9338 - protein, 123 aa, unidentified
  REGION 1..123: note = Description of Unknown:uncultivated organism sequence
EVFEVPGRLSKWKARVVKMHEAAARLVCGANIFDRHLDSKSRYLFSLMKGDCLQMHGEMSGIWIIKTIRANTQIELVSQYDARPVGSSKGGARVTRKCISEFQKFSPRKVVVLPIGDVVRCNE

SEQ ID NO: 9339 - protein, 119 aa, unidentified
  REGION 1..119: note = Description of Unknown:uncultivated organism sequence
EIFDCRGQWRCEVVSRWEAMRRLRAGEPVVRRQDAHGCPLVFSLARGDTVELKWKSGTLIAVVQKFSERDYTFRAHDDGRMDKEIREDRIRIRSDRRLQEVLVRKLSVDVLGRAYVSRE

SEQ ID NO: 9340 - protein, 129 aa, unidentified
  REGION 1..129: note = Description of Unknown:uncultivated organism sequence
EIVATLDAAGNEIRWEGITVSLFEALQRLRNKQPVVQRDHGPGKRFKFSLSGGEYLEFVENGRNKLVRVSVISGDDVEFRLHNDARPNTMLRGVKGARAGLVRSADALRKLKARKVLVDPLGNILPAND

SEQ ID NO: 9341 - protein, 120 aa, unidentified
  REGION 1..120: note = Description of Unknown:uncultivated organism sequence
EIYEVDEKGKKVWRGDVVSMREATERAARGTPITHRRGGVNTRYLFSVSKEDTLRLHGEHEGLWVVKKIAQKGQITLVSQYDARPEQGRTVFSPRLGGLQVHSAEKVVVLPIGDVVRCNE

SEQ ID NO: 9342 - protein, 124 aa, unidentified
  REGION 1..124: note = Description of Unknown:uncultivated organism sequence
EIYEVTSRGKTAWSGDVVTMRDAIGRASRGEPVVRRDGGPNSRFLFSLAKEDTLRLQGEKPGIWVVKKIRANTQMMLVPQYDARKEKDSSNGRESFSPTPGGLQKYSAEKVLVLPIGDVVRCNE

SEQ ID NO: 9343 - protein, 129 aa, unidentified
  REGION 1..129: note = Description of Unknown:uncultivated organism sequence
VAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGG

SEQ ID NO: 9344 - protein, 127 aa, unidentified
  REGION 1..127: note = Description of Unknown:uncultivated organism sequence
AIVARPGRRGRGEYWEDHIVSRYTAQQRLARGEPVIQKDWGPGRRLVMVLMPNDFIVMPDDRGVQQVYRVLSISEGDTELRLHCDARRAEDLKKARERVRVSGEKLRKLGGRRVEVSLLGELIGAHD

SEQ ID NO: 9345 - protein, 129 aa, unidentified
  REGION 1..129: note = Description of Unknown:uncultivated organism sequence
EIVATLDAAGNEIRWEGITVSLFEALHRLRNKQPVVQRDHGPGKRFKFSLAGGEYLEFVENGQKKLVRVTTVYHSNVEFRLHNDARPITMLLGVKGARAGLGHSVDALRKLKARKVLVDPLGNILPAND

SEQ ID NO: 9346 - protein, 127 aa, unidentified
  REGION 1..127: note = Description of Unknown:uncultivated organism sequence
EIYAIVDEHGNPVKYDGRCVTLLEAVQRKRRGEPVVCRNHGPNTRFLFSLSKNECIEWTNENGEKELLRVVGIADNDIEFRLLYDARPSNLVREAKDRIRGGYSKLFERRARKVLVTPLGEVLPAHD

SEQ ID NO: 9347 - protein, 126 aa, unidentified
  REGION 1..126: note = Description of Unknown:uncultivated organism sequence
EIYEVTANGKTTWSGDVVTMRDAISRASRGELVVRRSREPNSRFLFSLAKEDMLRLQGDKSGIWVVKKIKSNTQIVLVPQHDARKEKEKDKSNGRETLNPTASGLRKYYAEKVVVLPIGDVVVCHE

SEQ ID NO: 9348 - protein, 124 aa, unidentified
  REGION 1..124: note = Description of Unknown:uncultivated organism sequence
EIYEISENGRTVWTGDVVSMREAILRAARGEPVVRRSAGANGRFLFSLAKEDTIRLFGDRAGIWVVKKIKGNEQIILVPQHDARKEGSGAASRTEFAPTAGGLRRYSAEKVTTLPIGDVVPCHE

SEQ ID NO: 9349 - protein, 127 aa, unidentified
  REGION 1..127: note = Description of Unknown:uncultivated organism sequence
EIVEVTDARGRVRWEGKLVNMFEAYQRRRQHLPVVCRDHGPNANFLFSLACGEYVEMEHVPGQRKVYRVTTISGERLEFRLHCDARPITVLKKLPKARINRSASTLLEAKARKVFVDPLGNVYPAGD

SEQ ID NO: 9350 - protein, 130 aa, unidentified
  REGION 1..130: note = Description of Unknown:uncultivated organism sequence
IVWAKRTKEGEEGPWEFEPVRLLDAYDRVCRGLPVVNRDGGSDRIFKFSVSINEFIEMDDPDSGGRQLYRIKKTSLREIGVQLHHDARTVDEVRKAGDLNKYRISPSALKSRNARKVFVNHLGEVSGAGG

SEQ ID NO: 9351 - protein, 172 aa, unidentified
  REGION 1..172: note = Description of Unknown:uncultivated organism sequence
VAFYDQPLPGGGVERTAEVVPLHEAMRRHASGEPIVDRTPRGKKGEYAFAFSLAKNGYVWYRQKNSDEPVLCMVDGIADGDIELKRHTDGRGRPQRGKDRIRLRSKSIREGLFEKAHVTYLGEVRRAGGWARARLRRSARAPFRSPRAAGHPRRRRTRGHHAIGRGRHRRGR

SEQ ID NO: 9352 - protein, 131 aa, unidentified
  REGION 1..131: note = Description of Unknown:uncultivated organism sequence
ELYEVRKKGERRMVGVIVTTLVAAQRKAARRSVYNCRLIPNGSYMFSIHKGDVLRLEHPRKGEVLVTIRKISRLPGGNYVEGTEIKDARLDKDIKPKSIENGWFKLSDKQLGEMQARVVRITPLGEELDRV

SEQ ID NO: 9353 - protein, 135 aa, unidentified
  REGION 1..135: note = Description of Unknown:uncultivated organism sequence
EIVGVGEPDEHGEHPKWEAHVVSMFEAYQRKKNKEPIVKRDWSDETEKDGKPRKFLFSLAGGDTIELQKEEGKRELFIVRTVPQMKQVRFVPINDARRLKDIGKVGFTAYPETLRKWHCRKVAVNPIGEVHYQND

SEQ ID NO: 9354 - protein, 127 aa, unidentified
  REGION 1..127: note = Description of Unknown:uncultivated organism sequence
MIYAVLDKRGEVKKWDGEVVTLLEARRRLMNGEPLVNKVNTPTARYVMTVQRGDVFEMDIKGKRELVITRDVPQTKQMSFVRLNDARLKKEIKSSGEWFTKRPNSMRTSNVKKFTITPLGELRNSNA

SEQ ID NO: 9355 - protein, 125 aa, unidentified
  REGION 1..125: note = Description of Unknown:uncultivated organism sequence
AIYARHDADGREIGWDGEVVTVLDARLRLQRNEPVFPKVKEGNPLKFTLRKGDVVRWAKDGQEYLCVIRGISLPQFSCMPINDARDVKTLKAAGLWFTPTLSAAFRGKMEKFHTTPLGELRRAND

SEQ ID NO: 9356 - protein, 125 aa, unidentified
  REGION 1..125: note = Description of Unknown:uncultivated organism sequence
AIYSVLDKDGNEIGWDGEIVSLMDARLRMLKGEAVYPLEKNGNPLKFTLRKGDIVRWTKDGEELLCVIRGVALPQFQCVPVYEARDVKALKSAKKWFTPTLSAAFKGKMEKYTTTALGELRRAND

SEQ ID NO: 9357 - protein, 125 aa, unidentified
  REGION 1..125: note = Description of Unknown:uncultivated organism sequence
AIYARHDADGREIGWDGEVVTVLDARLRLQRNEPVFPKVKEGNPLKFTLRKGDVVRWSKDGQEYLCVIRGISLPQFSCMPINDARDVKTLKAAGLWFTPTLSAAFRGKMEKFHTTPLGELRRAND

SEQ ID NO: 9358 - protein, 125 aa, unidentified
  REGION 1..125: note = Description of Unknown:uncultivated organism sequence
AIYARHDADGREIGWDGEVVTVLDARLRLQRNEPVFPKVKEGNPLKFTLRKGDVVRWSKDGQEYLCVIRGISLPQFSCMPINDARDVKALKAAGLWFTPTLSAAFRGKMEKFHTTPLGELRRAND

SEQ ID NO: 9359 - protein, 140 aa, unidentified
  REGION 1..140: note = Description of Unknown:uncultivated organism sequence
ALFVTRDEKRREKWDSEVAQVTEIYRRCPRNDRRKSRSQPVVIESPISRQLKSDPEAQFLFSVMKDDTIEVTDPNGIYILRVKKFSDNKQMWFVPVNDAHDDTQQMKLGITWSKTPNSLKELRPRKVVVDLLGKVHPAND

SEQ ID NO: 9360 - protein, 127 aa, unidentified
  REGION 1..127: note = Description of Unknown:uncultivated organism sequence
GLFVVRDARRREVWESEVVQITDAYERHREHLPVVCRTHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 9361 - protein, 140 aa, unidentified
  REGION 1..140: note = Description of Unknown:uncultivated organism sequence
ELFVARDEKRREHWLSHVVQTTEMYDLFPKRDHRPGRPKAVTKSIPIRRQMPGQPEAEFLFSLLKNDTIELEKAGCREIFRVKKFEATGKITFVPINNAMPDTLQYGTGSAWSKMPTTLKVMSPQKVVIDLLGRVHPAND

SEQ ID NO: 9362 - protein, 140 aa, unidentified
  REGION 1..140: note = Description of Unknown:uncultivated organism sequence
ALFVTRDEKRREKWDSEVAQVTEIYRRCPRNDHRKGRSQPVVTESPISRQLKSDPEAQFLFSVMKDDTIEVTDPNGIHILRVKKFSDNKQMWFVPVNDAHDDTQQMKLGITWSKTPNSLKELRPRKVVVDLLGKVHPAND

SEQ ID NO: 9363 - protein, 127 aa, unidentified
  REGION 1..127: note = Description of Unknown:uncultivated organism sequence
EVIRQTDPRTGKTKWALAAVTCQQAMERVRDHKPLVSRDHGPHAEFVCSVAKDDTLEINEAGNKRLVVVKALEAGRNVVGFKDLRDARPYSATTKNRERVAVARLMDALKCRKVTVSPLGETHYAND

SEQ ID NO: 9364 - protein, 140 aa, unidentified
  REGION 1..140: note = Description of Unknown:uncultivated organism sequence
DLFVTRDEKRRETWDSKVIQTTEMYDRFPKHDRRPGRPHTESKNLSRLRQNDDDDESRFLFSLMKSDTIQLEQDGHRQIFKVKKFEATGKMTFIPINNAMPDKLQYSTGAAWSKMPATLKSMSPQKVVVDLLGRVHPAND

SEQ ID NO: 9365 - protein, 127 aa, unidentified
  REGION 1..127: note = Description of Unknown:uncultivated organism sequence
GLFVVRDARRREVWESEVVQITDAYERHREHLPVVCRIHDAEEAAFLFSLMKDDTVELEKDGTRGIYRVKKFEATGKITFVPVNNAMLDKMQYTTGAAWSRMPATLKPMSPRKIVIDLLGKVHPAND

SEQ ID NO: 9366 - protein, 141 aa, unidentified
  REGION 1..141: note = Description of Unknown:uncultivated organism sequence
AIYRLSADKKGTARWTGEAVSLLEALKRMNLPGRPVIAPVNESGAPLVMALYKGDLVEMTVPKSQPPERDLFVVRGFSIEKRGGPEINFVRHNLAAEIADLKDAGEWQRIRSWDELRLLNPRIVRLGAMGRVMPDDSQPNS

SEQ ID NO: 9367 - protein, 128 aa, unidentified
  REGION 1..128: note = Description of Unknown:uncultivated organism sequence
EILKELDANGRVKRYLCETVTMLKALERKRQGVPVVSRDHGPGYKFHCTLSEGDLVEARGPGDEALRIWKVRTVRDSQQLALTPALDARPKADVQKDGMWSPRVNSLFLGGARKVLITPLGEVIPAND

SEQ ID NO: 9368 - protein, 123 aa, unidentified
  REGION 1..123: note = Description of Unknown:uncultivated organism sequence
EVVEVLDKNGKPKWEGCLVSLKDAYDRLKAGLPVVKLDHGEGRRFVFSLAKGEAIKIDEENGGNRGLYVVKKLGDNRIWFVDTREARKLKEAGYNSKLMEPLRTLNCQKVLITPLGEVRRAND

SEQ ID NO: 9369 - protein, 135 aa, unidentified
  REGION 1..135: note = Description of Unknown:uncultivated organism sequence
EVFAYLDEKGNEYEWDGAVVSMAEAYRRTYSKPPLPPVQRNHGPETQYKFSLSPGEIIQCDPDNKGNSKLLVVRSVSQFETGTVQIGLAEINDARKKSDMTKDRKFIRVVPNKLRQWNARKVAVSPLGEVSEAND

SEQ ID NO: 9370 - protein, 133 aa, unidentified
  REGION 1..133: note = Description of Unknown:uncultivated organism sequence
EIFSKLDEDGNEVGWDGAVVSMLKVYSRKRLGLPIVQREHGPGTQFKFSLGAGEVVECDIAPGQRGLFVFRKVSRITATDQIQIGFAPLNDARKAKDMQTSRSWLWSGPNRLMERHARKFVVNPLGEVSEAHD

SEQ ID NO: 9371 - protein, 125 aa, unidentified
  REGION 1..125: note = Description of Unknown:uncultivated organism sequence
AVFAVQDAQGNESSWEGEIVTLMDAVYRKQHDLPLFERERPGRKFKFTLKKGDIVKWNKDGVEQLCVIRGVSLPQFSCVPVCDARQQKELKNAKCWFTPTLSAAFAGKMTKYRMDILGELRRAND

SEQ ID NO: 9372 - protein, 125 aa, unidentified
  REGION 1..125: note = Description of Unknown:uncultivated organism sequence
AIFAVLDEQGNETAWEGEIVSLMDARYRLTHKMPLFEKDRPGRKFKFTLKKGDIVKFRKDGTEYLCIIRGVSLPQFSCCPVKDARMQRDLKAAKVWFTPTVSAAFQGTMTKYRMNIFGELQRAND

SEQ ID NO: 9373 - protein, 136 aa, unidentified
  REGION 1..136: note = Description of Unknown:uncultivated organism sequence
EVFASLDAQGRESKWESITVSLLEASERNRKKQKVVQRLYPESEDYTFKFSLMGGDSVDLHRNCDHNLGRCNPALYRVRTIAANGQLSLVKITDARLKQDIQKVSEWWSPMCNALRKLDCRKVVVDLLGRVHPAND

SEQ ID NO: 9374 - protein, 132 aa, unidentified
  REGION 1..132: note = Description of Unknown:uncultivated organism sequence
EIFAELDQQGKEREWDGIVVPMHEAWRRLRAGEPVVNRDAGPGRLYKFSLAQGEVVECDGKHEGRSLFVFRKVTQFTKGGIQIGFAPLNDARKAREMQVARAWLWTTPNTLGDRHARKMTVNPLGEVTEAHD

SEQ ID NO: 9375 - protein, 128 aa, unidentified
  REGION 1..128: note = Description of Unknown:uncultivated organism sequence
VIYAELSEDGSDQRWRESVVTRFEALSRVRFGDPPVLRTLQQGLVFRFSLRRNDCIELADPDGMRRLYRIMNVSKGDMQIQQLSDARSSKVLRDNKLRLRITNVDELRRRCCRKVQVSPLGDVFADNT

SEQ ID NO: 9376 - protein, 136 aa, unidentified
  REGION 1..136: note = Description of Unknown:uncultivated organism sequence
AVFAQMDAHGREKRWDSVIVSLFEAMERKRKKLPIIQESYPDADNYVFKFSLMGGDLIEIHRNCNHAQETCVPTIYRVRTIATNGQLSLVRVNDARLKQDIQKVKEWWSPMAGTLKQLDCRKVVIDVLGKVHPAND

SEQ ID NO: 9377 - protein, 129 aa, unidentified
  REGION 1..129: note = Description of Unknown:uncultivated organism sequence
EIFEEMQKNGEIKWTGKTVSMFEAAQRLKKREPVINREQTDNRRFVCSLALGDIIELEEERGKKELFVIKTITIQRRKNTDYSQVFYAPINLSNPKKEGLKGKLINKLKELNCRKVIITPLGEVRQAND

SEQ ID NO: 9378 - protein, 129 aa, unidentified
  REGION 1..129: note = Description of Unknown:uncultivated organism sequence
EIFEEIQKNGKTKWTGKTVSMFEAAQRLKKLEPVINREQTDNRRFVCSLALGDIIELEEEHGKKELFVIKTITIQRRENTDYPQVFYAPINLSNPKKEGLKGKLINKLKELNCRKVIITPLGEVRQAND

SEQ ID NO: 9379 - protein, 131 aa, unidentified
  REGION 1..131: note = Description of Unknown:uncultivated organism sequence
AVVAVLNEKGEEIKWEGHVVTRLEAIQRKSRKEPVIQQIWGDTEKSLKRVFKFSLRSGDTITLEHGEKGGVWLVCGVSGKLIQVRRNNDARLKKDICSAGDWWQPAINSLRNSCLQRLSVQATGVLRNWNA

SEQ ID NO: 9380 - protein, 141 aa, unidentified
  REGION 1..141: note = Description of Unknown:uncultivated organism sequence
EIFEVLGKDGTVTKWQGRVVTRLDAYQRRKQRQPIVNRHWDENRRFLFSLTQGDIIELDVDLGNDEIVRELYLVRGVTFLAGGLIQCSHILDARKKKEIPMKPSADEKIRIFKNPVVNTLNRLRCRKVSVTPLGEVYPAND

SEQ ID NO: 9381 - protein, 141 aa, unidentified
  REGION 1..141: note = Description of Unknown:uncultivated organism sequence
EIFEVLGKDGTVTKWQGRVVTRLDAYQRRKQRQPIVNRHWDENRRFLFSLTQGDIIELDVDLGNDEIVRELYLVRGVTLQGGGMLQCTHILDARKKTNIPTTATAQEKIRIYLRPPVNTLNRLRCRKVSVTPLGIVYPAND

SEQ ID NO: 9382 - protein, 130 aa, unidentified
  REGION 1..130: note = Description of Unknown:uncultivated organism sequence
DVFHQEDGYYWVPIYVADTVKETLPAKACVAFKPYELWKEMDDKDFIFSLYPNDLVRYLQKNGNEGFMYYVKAGISTASITVESHDRALSIPSLGVKTLKELEKWNVDALGNRTKVNKEKRQYYPGQMVR

SEQ ID NO: 9383 - protein, 156 aa, unidentified
  REGION 1..156: note = Description of Unknown:uncultivated organism sequence
EFYRNDKGEFKESVISYWQAFLRIKNHLPLFVNIDNASILRKAIEEGFDIGEIHDSSWDPFLCLGKTELVVIGLKKRTIENLIKRGDYSKIASHVYKVCGVSQGDYTFCIHNEIKYVPKERNKPDGRFIRIQNIKSLANLELVKVKINPIGEITIL

SEQ ID NO: 9384 - protein, 156 aa, unidentified
  REGION 1..156: note = Description of Unknown:uncultivated organism sequence
EFYRNDKGEFKESVISYWQAFLRIKNHLPLFVNIDNASILRKASEEGFDIGEIHDSSWDPFLCLGKTELVVIGLKKRTIENLIKRGDYSKIASHVYKVCGVSQGDYTFCIHNEIKYVPKERNKPDGRFIRIQNIKSLANLELVKVKINPIGEITIL

SEQ ID NO: 9385 - protein, 130 aa, unidentified
  REGION 1..130: note = Description of Unknown:uncultivated organism sequence
DIFRQEEGYYWVPIYVADTVKKTLPAKACVAFKPYELWKEMDDKDFIFSLYPNDLVRYLQKNGNEGFMYYVKAGISTASITVESHDRALSIPSLGVKTLKELEKWNVDALGNRTKVNKEKRQYYPGQTVR

SEQ ID NO: 9386 - protein, 143 aa, unidentified
  REGION 1..143: note = Description of Unknown:uncultivated organism sequence
EVYAVLDEQGEEKRWEGRLVSLYEAMSRARAARRGEETLPVVQRDHGPETRFKFSLTGNDVIDLEEDDEVRQLYRIRSINQEQAKTGRQPSPRVEFCDLADAREVKPMKKAGRYFKPAVNSLKGRRCYKVIVSPIGEVFPAHD

SEQ ID NO: 9387 - protein, 134 aa, unidentified
  REGION 1..134: note = Description of Unknown:uncultivated organism sequence
RIIATLDKDGNEKSWRDEIVTRFEMYHRRANGTLAADAALRENERFKFSLAANEFVEIDDLDPDGKVVGRMLCRVLSISKGDIELVHHLDGRPSTARSTVEKGRLRARSMAWFKDRNANKVFINYLGEVKGAGG

SEQ ID NO: 9388 - protein, 136 aa, unidentified
  REGION 1..136: note = Description of Unknown:uncultivated organism sequence
RIIATLAPDGTEKAWRDEIVTRFEMYRRKAADTRLSPWVDRTVGSNERFKFSLASNEYVEIDEWDASRRPTGQRLVYRVLGVSDGNFEICHQCDGRTVRQRRDARARKTTSGVDLFKRNARKVFVNYLGEIKDAGG

SEQ ID NO: 9389 - protein, 125 aa, unidentified
  REGION 1..125: note = Description of Unknown:uncultivated organism sequence
ELIATLDAHGNEAEWQGRVVPMRDAYLRVRLHAPVIDRTCDPSEEYKFSLCPGEVIECWRGDGPELLVYKGVSQYTAGQVVISLLPLNEAGKNPKLIRVVPNRLRQWHARKVVVSPIGEVTEAHD

SEQ ID NO: 9390 - protein, 126 aa, unidentified
  REGION 1..126: note = Description of Unknown:uncultivated organism sequence
EVFAEVNERGQVTGWDCEVVSLLEAVRKKQAREPIVRKEGSEGREFLFSLAPGDILEMDGQGGTRELAVIRAISQEPRIAYVSVRDARKKSEMEAAYVRKTPNALFKLNARKVRVSPLGDVSEAHD

SEQ ID NO: 9391 - protein, 126 aa, unidentified
  REGION 1..126: note = Description of Unknown:uncultivated organism sequence
EVYAELDAAGREIKWVADTVTLFDAYERKIKRLPVINRDHGPNTVYKFTLFKNEFLEITNSDGSTTLKRVFKFSGQRVGFGDHNDARPANDVTDKTPGNYPSINSLRGKAQKVSVDLWGDIHPAND

SEQ ID NO: 9392 - protein, 123 aa, unidentified
  REGION 1..123: note = Description of Unknown:uncultivated organism sequence
ELFFKKEGKKEVPDGDPVSMFEAYQREKRGEPIVKRDHGPGTRFLCSLHKRECLEIYDPENQEVRLYVISTIKSNKQIFYQLHSDAVPAASKKGLSVTPETFVKKGVRKVYVDVLGEIHPAND

SEQ ID NO: 9393 - protein, 126 aa, unidentified
  REGION 1..126: note = Description of Unknown:uncultivated organism sequence
EVFAEVNERGQVTGWDCEVVSLLEAVRRKQAREPIVKKEGSEGREFLFSLAQGDILEMDGQGGTRELAVIRAISQEPRIAYVSVRDARKKSEMEAAYVRKPPNALFKLNARKVRVSPLGDVSEAHD

SEQ ID NO: 9394 - protein, 122 aa, unidentified
  REGION 1..122: note = Description of Unknown:uncultivated organism sequence
EIYKDLATGRWDGEVVSLFKAHQRLRSKQPIIRKHHGEEKKFLFSLAGGETIELDTEDGKRGLFVVRTVPQSKQIVFVPINDSRKRKDIGTTGLTAYPESLKERHCAKVLITPLGEVRRASD

SEQ ID NO: 9395 - protein, 122 aa, unidentified
  REGION 1..122: note = Description of Unknown:uncultivated organism sequence
EIYKDLTTGRWDGEVVSLFKAHQRLRSKQPIIRKHHGEEKKFLFSLAGGETIELDTEDGKRGLFVVRTVPQSKQIVFVPINDSRKRKDIGTTGLTAYPESLKERHCAKVLITPLGEVRRASD

SEQ ID NO: 9396 - protein, 125 aa, unidentified
  REGION 1..125: note = Description of Unknown:uncultivated organism sequence
EIFETTNKRGEVKWEDRIIDQFEAVRRLRRGEPVVRRDYGDGKRFVMSLAVGDTVMLLKEQKESLWIVRSIWKGRVSLSPCNDARKQADLKKSGVFNSPAIDSLRNWNCRKVVVTPLGEIRWAND

SEQ ID NO: 9397 - protein, 142 aa, unidentified
  REGION 1..142: note = Description of Unknown:uncultivated organism sequence
EVYANLDDDGDEMRWQGRLVSMYEAMARVRARKIGSDVAVVEKDHGKRTKFKFSLAPGETIELQEPQGEPRLYIVRSISQERTSGGRRPAPIVEFVDVRDARLKKDIKTANAWGKRAVNPLGELGCRKVLVSPVGEVFPAHD

SEQ ID NO: 9398 - protein, 133 aa, unidentified
  REGION 1..133: note = Description of Unknown:uncultivated organism sequence
EIVETKDKKGRLKWEGSVVSMFEATRRLKAKEPVVKREDGEGRKFLFSLAQRDTVLMKDLGDEKELFLVTGISQYQQGPIVITLRRNCDARKDKVGKGEQDEIHAYRTPDSLRKSAGEKAIITPLGEVRRAND

SEQ ID NO: 9399 - protein, 131 aa, unidentified
  REGION 1..131: note = Description of Unknown:uncultivated organism sequence
EILAELDQGGEERRWFGRVVSTLEANRRLRARPLEAIVDRGCGPGQRFKFSLCRGDALLLRQDEHERLWLVQKISVNQRGATHIVLKPPADARPVREIPTHGRIHSPNTLFRHSARKVTVDPLGTLRDARD

SEQ ID NO: 9400 - protein, 125 aa, unidentified
  REGION 1..125: note = Description of Unknown:uncultivated organism sequence
EIIEEQDRKGNPVWRAVVVSRYEAMRRKASGQPVVQRDHGEGKRFVCSIASGDTFSFQENGGTVLAIARSISDQNIEFVTINDARLKADIKKAGDWKKRSVNAFRTMCFQKVMISPVGEVYPAHD

SEQ ID NO: 9401 - protein, 131 aa, unidentified
  REGION 1..131: note = Description of Unknown:uncultivated organism sequence
EIFAELDENGNEIEWDGCVVSMAEAYKRKKLGLPIVQRDFGPNRRFKFSLAPGEVIECDSEEGMRNLWVVRGATSENSRPRLFLVPINDARKKSEIVNAGLYWRPFLNPLRNLNARKVVVSPLGEVTEAHD

SEQ ID NO: 9402 - protein, 128 aa, unidentified
  REGION 1..128: note = Description of Unknown:uncultivated organism sequence
EIFEVKDSKGRIKWDGKLVSRYEAMQRLRNRQPIVHRDHGPDKKWVFSLAGGESVQMKDPESGTPGLFVVTGISEGEITMLRNADARPSKVLRKTRGARVRPAPDTLRKLGAKKVTITPDGEVRRAND

SEQ ID NO: 9403 - protein, 140 aa, unidentified
  REGION 1..140: note = Description of Unknown:uncultivated organism sequence
IIWQSTKPDAKGRIRRELEVVTMIEAATRASCGEPVFSARHSNRGPEWKPFLFLCKNDIVEYDDPKHGRRLMRVAKFSITERSNNGIMLRPVRDAREIKENNVVVKGQDALARILRRVILSPLGDEIGSEPQYADDQPGS

SEQ ID NO: 9404 - protein, 132 aa, unidentified
  REGION 1..132: note = Description of Unknown:uncultivated organism sequence
EIIETRDARGRIRWEGIVVSLFEAVRRRAEGRPVVQRDHGPNKRFLFSLVKGDAIELQENGIPVLYRVTGISKDLRGVVQIEFARNSDARPKKVRGRKGLTATPDKLRKKHCVKVIITPIGQKRYIPEGSEA

SEQ ID NO: 9405 - protein, 127 aa, unidentified
  REGION 1..127: note = Description of Unknown:uncultivated organism sequence
EIFAHLDAQGNETRWDGHVVSLLEAVGRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 9406 - protein, 133 aa, unidentified
  REGION 1..133: note = Description of Unknown:uncultivated organism sequence
EIFETKDKKGRIIWDANVVSMFEAMQRKRRGEEIIQRKLIRDGKVVEDAKFLFSLCKGDMVYMKDSEGEYQYYKLVIVSEYASGAKVMFFLPHHVAKIPKSWVGLTKTSSALQKSEAKKCSINVLGETHIAHD

SEQ ID NO: 9407 - protein, 154 aa, unidentified
  REGION 1..154: note = Description of Unknown:uncultivated organism sequence
EIFETKDKKGNVRWDGAIVSQYEAMRRLRAGEPIVKREHGKGKEFKFSLALNECVKLLDEKGQEIVCVVKGISQLSAGPIVITLRHICDARPTSEYQKQIKMRKELKKNYDKKLAEEIEKMLPVFIFKGPDSLREAKGQKILITPLGEIRTAND

SEQ ID NO: 9408 - protein, 127 aa, unidentified
  REGION 1..127: note = Description of Unknown:uncultivated organism sequence
EIFAHLDAQGNETRWDGHVVSLLEAVRRKRLGQPVVCRDHGPNTRFKFTLAKGDYIQWTDDQGQPQILRVIGISHNNIEFRLPSDARPITIIKQEKQRIRARYQTLFQRRARKVAVSPLGEVYPAGD

SEQ ID NO: 9409 - protein, 144 aa, unidentified
  REGION 1..144: note = Description of Unknown:uncultivated organism sequence
IIWQRKLRDKKGRLRREMEVVTMIEAATRACCKEPVFSAEHSGRGVEWEPFLFLCKNDIVEYDDPNEGRRLMRVAKFSSWQVQGKRKTTERAELVLRPIRDAREIQDHNVRVSGQDALARILRRVILSPLGDVVGSEPPDAQHQ

SEQ ID NO: 9410 - protein, 128 aa, unidentified
  REGION 1..128: note = Description of Unknown:uncultivated organism sequence
EVFEKPDGSWMGEVVTMLEAMRRKKTGEPIIRRQDNEGRRLLFSLSRGEAVQINTGTGERVTAVVQTISGPNPGKVDIEFRRHSDARKAEDVRKAGDRIRVSSYADLKQREARKVLLTPLGEIRWAND

SEQ ID NO: 9411 - protein, 128 aa, unidentified
  REGION 1..128: note = Description of Unknown:uncultivated organism sequence
EIVEVTDARGRVRWEGKLVNMFEAYQRRRQHLPVVCRDHGPNAKFLFSLACGEYVEMEHVPGQRKVYRVTTISEGQLEFRLHSDARPIKELKIAGSRARVRRSPNSLLEAKARKVFVDPLGNVYPAGD

SEQ ID NO: 9412 - protein, 132 aa, unidentified
  REGION 1..132: note = Description of Unknown:uncultivated organism sequence
EIYAELDEHGNEKKWGGEVVSMAEAYQRLKTGKPIVQRDHGPLVKFKFSLAPGEVVECEGKDGMRGLFVMRKASQLTSGQLQIGFAPLADARKAREIQTSRAWLWASPNTLGERNPRKVVVSPIGEVTETHD

SEQ ID NO: 9413 - protein, 132 aa, unidentified
  REGION 1..132: note = Description of Unknown:uncultivated organism sequence
VIVARQTPSGEVWEDNPVDRLEVHRRLRNGQPVIQTDWGSDARYVFHLCKNDCIEMDVESGNPSAGRQIYVVRSISKRDIAVRLHYDARTLEQIVRAKERGKFRISSADLLRRRNARKVMVSPLGEVLPCRE

SEQ ID NO: 9414 - protein, 134 aa, unidentified
  REGION 1..134: note = Description of Unknown:uncultivated organism sequence
EIVATLDELGNEVKWEGVVVSMLEAYERRRACLKAGKPVQVVQRDHGPGKRYKFTLHCGDFIEVDMPDGKREIFVVRVLAQTKEIASAPLNDARKKSDMQKAKAWLRLIPGSLKSRNARKVVLTPFGEVRSAND

SEQ ID NO: 9415 - protein, 127 aa, unidentified
  REGION 1..127: note = Description of Unknown:uncultivated organism sequence
EIYAVIDGQGQEVQWTGKIVSLYEAYERKKRGEPVVCRDHGPNTRFKFSLAKSEYIEWINDDGQKQLLRVVGISHNNLELRLPYDARPITLIREQRERIRATYRQLFQRRARKVMVTPLGEVLPAND

SEQ ID NO: 9416 - protein, 157 aa, unidentified
  REGION 1..157: note = Description of Unknown:uncultivated organism sequence
EIVAVLDAEGSETKWEGHIVSTYEAMKRLVAADKPGARALSSRKGNANLPPVVRKDHGPSRTFLFSIAPGDTLEIRNPSAWKDTWADKPNFIVITTVSVSNSGSIEVAGHSLEDARLQKEIKKDKALYRIRSMKTMRELQPKKVNVSPLGDVTPAND

SEQ ID NO: 9417 - protein, 129 aa, unidentified
  REGION 1..129: note = Description of Unknown:uncultivated organism sequence
VIVATLDKYGNETRWDDYPVTRLEAHRRHAAGRPIIRKDWGENRKVKFTLTRNEYLLVRDQEGGDRLIRCISVSEGANEFRLHTDARSATEARKPGSGARIGLSGENMRKRNARKVRVTMLGDVIPCHD

SEQ ID NO: 9418 - protein, 127 aa, unidentified
  REGION 1..127: note = Description of Unknown:uncultivated organism sequence
EIVEVRNPENGEIKWEGHVVSMFEAYQRHKNGEPIVKRNYGENENFLFSLAGGDIIELDNPEDNMRELYIIRTVPKSKQLYFVPVNDARKLSDIGKKGLTAPPDSLRIRKCQKMVITPLGEIRTANN

SEQ ID NO: 9419 - protein, 134 aa, unidentified
  REGION 1..134: note = Description of Unknown:uncultivated organism sequence
EIFEVKDKKGKPKWEGEVVSRFEAMRRKKEKEPIVKRDHGPDKKFLFSLALGEVIEIDEEEGKRGMYVLRSVFSNIHKEKKSPRIAFVKINDARLKKEIKDSGDWKTSFLEPLRKLNCRKVSVDPLGRVRPAND

SEQ ID NO: 9420 - protein, 134 aa, unidentified
  REGION 1..134: note = Description of Unknown:uncultivated organism sequence
EIFEVKDKKGKPKWEGEVVSRFEAMRRKKEKEPIVKRDHGPDKKFLFSLALGEVIEIDEEEGKRGMYVIRGVSTVKPKDKPYPHLSFVRINDARLKKDIIAAKDWGTSLLDPLRKLNCRKVSVDPLGRVRPAND

SEQ ID NO: 9421 - protein, 128 aa, unidentified
  REGION 1..128: note = Description of Unknown:uncultivated organism sequence
EIVAILDNEEKEIKWEGYVVSMLEARKRLKSGKLLVRKDFGTGKVFKFSLACGDIIKLTEEDGSEVFRVIRTVPQSKQLCFVALNDARKQADIKAAGEWYSAMPNSLLKKSCKKYTVTPLGVIRRAND

SEQ ID NO: 9422 - protein, 134 aa, unidentified
  REGION 1..134: note = Description of Unknown:uncultivated organism sequence
EIVAALDEEGTEVKWEGHVVSMLEAYRRKQDCLRRKEHPDVIKKNYGPGKLYKFSLFCGDFIELDMPEGLREVFVIRAVPQSKQIMFVQCNDARLQKEIKAAKKWFSGYPDSLRKRNARKVHLTPFGEVRNAND

SEQ ID NO: 9423 - protein, 140 aa, unidentified
  REGION 1..140: note = Description of Unknown:uncultivated organism sequence
AMFVTRDKKRCEVWKSNVVQITDIYQKLPRHDRRKGRPKSPSQGPVVFRGFPDDPDAQFVFSLMKDDTVALDVNGQARIFRVKKFSDNGQIWFVPANDAHDNATQMKSGITWSKKPNTLKELHPRKVVVDLLGKVHTAND

SEQ ID NO: 9424 - protein, 124 aa, unidentified
  REGION 1..124: note = Description of Unknown:uncultivated organism sequence
EVFSVLDRRGSVKRWDCVIVSKAEAAERVRTKRPVVCREHGPNTCFAFTIAKGDTFEIERDGVPEVVVARVLEGDKRVSLFSIRDARRQEKRNALRCTVNELMKKYKLQKVAITVLGEKIACRD

SEQ ID NO: 9425 - protein, 127 aa, unidentified
  REGION 1..127: note = Description of Unknown:uncultivated organism sequence
EIFAELDQKGKEIEWDIFIVSLAEAIRRKHSRESVVSKNHGAQETFKFSVAPGDVIEMDVASGRRQYFVVRGTSYPSVSLAPIADARQKKELVKDHAYLRMVPNSLRKKNARKIHVTPLGDVEEAHD

SEQ ID NO: 9426 - protein, 130 aa, unidentified
  REGION 1..130: note = Description of Unknown:uncultivated organism sequence
AIVAEMDTKGDIKRYVFSTVTMLEALERKRQGVPVVQREHGPGMQFLCTLSDGDMVEGKRPGDAVPRLWKVHTVDKNGRIFLSAALGARKKDEIKKAHDHWEPTVNSMFAAGGARKVLVTHLGEVIPAND

SEQ ID NO: 9427 - protein, 132 aa, unidentified
  REGION 1..132: note = Description of Unknown:uncultivated organism sequence
EIYAQLDGQGNVGAWDGEVVSMYEAYQRQKTRKPVVRRDHGPPVKFIFSLAPGELIECDGKSGGRSLFVVRKASRLSSGQLQIGFAPINDARKAKEMQTSRAWLWATPESLSHRHPCKVLASPLGEVSETHD

SEQ ID NO: 9428 - protein, 146 aa, unidentified
  REGION 1..146: note = Description of Unknown:uncultivated organism sequence
SFFNVQNRRGTKWKWDVVKLFDAAQSIQSVPKRERARTNIFALPSDEFKKSLRDDDEVTYRFSLMKGDLVEMENGEIVIVRRFESDGRIWISAVNAAGTDKMLNETNSLHRIGLSDFLKKRPKDSDSPQPIRIDPIGNKSRIELGA

SEQ ID NO: 9429 - protein, 141 aa, unidentified
  REGION 1..141: note = Description of Unknown:uncultivated organism sequence
SFFNVQDRRGTKWVSEIVKLFEATQRVRALPKAERGKQRISERHSKFPDAVFRFSLMKGDLVELLHEGKVGVFVIRSFEADNRIKVAPINAASRDDDLKKAGHLLRLGFTEFLSMGAGEDKVPRPVTIDLLGQAHYIKLRA

SEQ ID NO: 9430 - protein, 130 aa, unidentified
  REGION 1..130: note = Description of Unknown:uncultivated organism sequence
VIYAELNLKGETARYRSCTVTMLEAYERQRQGVAVVQRDHGPGTVFRCTLSEGDLLEAKRPGTEPAAIWYVRSVKSNEKIVMSPSRDARRKDEIIASRDLWEIAANVAFKQCGARKVLVNHLGEVIPAND

SEQ ID NO: 9431 - protein, 160 aa, unidentified
  REGION 1..160: note = Description of Unknown:uncultivated organism sequence
EVFEIDDANGPRYVSRTVSLLEAKTRCNRKQPVIDERLTSLNGVSGRLPKGAKYKHLFVCALMIGDLILLHRDCEHENDVCIPGIYRIRGIAANGQVTVMPLNETRSAVELDKAHEGWSPKVDALRKMGMAPVKVDLLGELHPNGGKIDLFQPRKVATHQ

SEQ ID NO: 9432 - protein, 135 aa, unidentified
  REGION 1..135: note = Description of Unknown:uncultivated organism sequence
AVFAITGDKGEEKRWSSQIVSLFEAMERKRKGEAVVQTSMQEDPHAVFKFALMKGDMLLLHKDCDHGKSLCQPSYWKVRSIWEQGTLTLVQIHDARQIKEIYAAKDWLLSSANTLRKLEAMKIEIDSLGRIHRAG

SEQ ID NO: 9433 - protein, 130 aa, unidentified
  REGION 1..130: note = Description of Unknown:uncultivated organism sequence
EFFARRDRKNREEWTHIPVSIIEAHVRYGRKNPVIARAHSEDQNAEFVFSLMKGDTVEMDYNGSRDVFKVKKFYSSGQIWFTQINNAQKDEEQKKDKTAWSVNPNPLRLLNPQKVTIDPLGRKYGVNRAT

SEQ ID NO: 9434 - protein, 128 aa, unidentified
  REGION 1..128: note = Description of Unknown:uncultivated organism sequence
AFFVVRGPNRKEKWDSRVVQITDAYERRRRKLPVVSRELATIPDAEFLFSVMKDDTVEVSDPKGTRVLRVKKFNDQKQMWFVPVNDAHDDGQQMKLGIAWSKKPSGLKDLCPRKVVVDLLGKVHAAND

SEQ ID NO: 9435 - protein, 140 aa, unidentified
  REGION 1..140: note = Description of Unknown:uncultivated organism sequence
ALFVARNDTRQEQWLSEVAQVTDVYQRCPRRDKRIGRPKSIANEPAVSRKLKDNPEAEFLFSLMKDDTVELDYNGAREVFRVKKFYAAGPIWFTGVNNAQMDADQKKNKTTWSKNPNGLKTLHPRKVVVDLLGKVHPAND

SEQ ID NO: 9436 - protein, 127 aa, unidentified
  REGION 1..127: note = Description of Unknown:uncultivated organism sequence
ELFVRRESHKEIWVHSPVTLMEAYFRHRQNTPIVARKLEDDPDAEFLFSLMKGDMVEMNYKGQRGNFRVKKFYSSGQIWFADGNNAQQDKDQQRDGTRWSKRPDALRELRPRKILVDLLGKTHPAND

SEQ ID NO: 9437 - protein, 128 aa, unidentified
  REGION 1..128: note = Description of Unknown:uncultivated organism sequence
ELFVRRDEKRRETWDSRVVQITEAYERRREKTPVVARILEGDLEAQFLFSISKDDTLEIQDGDLRRIVRVKLFYDNKQIFYVPVNDAHLDADQKKLAIVKSKYPNSLRPLEPRKVVVDLLGRVHPAND

SEQ ID NO: 9438 - protein, 128 aa, unidentified
  REGION 1..128: note = Description of Unknown:uncultivated organism sequence
VFFVTRDQNRREKWDSTVVQITEAYERRSRKQPVIARTLSTDTEARFLFSVMKDDIVQVTENGVTRLLRVKKFGENKQIWFVPINDAHDDANQKKLGITWSKKPNTLKDLKPQKVAVDLLGRVHPAND

SEQ ID NO: 9439 - protein, 140 aa, unidentified
  REGION 1..140: note = Description of Unknown:uncultivated organism sequence
ALIVARNETRQEQWLSEVAQVTDVYQRCPRRDKRSGRPKAIANEPAVSRKLKDNPEAEFLFSLMKDDTVELDYNGAREVFRVKKFYAAGPIWFTGVNNAQMDADQKKNRTTWSKNPNGLRTLNPRKVVVDLLGRVHPAND

SEQ ID NO: 9440 - protein, 126 aa, unidentified
  REGION 1..126: note = Description of Unknown:uncultivated organism sequence
EVVADTDKHRNEIWDISNVVTRYEANRRLGASEPVVRRNWGEGKKLVMALQRGDHLELEIAGVPQLMRVVSIGTNWLQLQPPAFGSPKMEKVDRNAWLFQSARRFQAANPRKVSVSPIGEIRPCNE

SEQ ID NO: 9441 - protein, 140 aa, unidentified
  REGION 1..140: note = Description of Unknown:uncultivated organism sequence
ALFVARNETRQEQWLSEVAQVTDVYQRCPRRDKRSGRPKAIANEPAVSRKLKDNPEAEFLFSLMKDDTVELDYNGAREVFRVKKFYAAGPIWFTGVNNAQMDADQKKNKTTWSKNPNGLKTLNPRKVVVDLLGKVHPAND

SEQ ID NO: 9442 - protein, 136 aa, unidentified
  REGION 1..136: note = Description of Unknown:uncultivated organism sequence
AIFAELDEHGKERRWEPIVVSLYEAMNRRRRGLPIVQQAYPGAEDCVFKFSLMGGDTVLLHRDCDHAKDICIPRAWRIRTITQTGRVALVPINDARMKVEIKSSKDWWEPGIDALRKLGCEKVVIDTLGRPHVTSD

SEQ ID NO: 9443 - protein, 129 aa, unidentified
  REGION 1..129: note = Description of Unknown:uncultivated organism sequence
EVVGQLDASGQIARYACHTVTLLQALERKRQQAPVVQREHGPGCRFVCTLSEGDLLEAQRPEDPEPRIWKVRSVRQSGQLELTPSLDARMKKEIEEAGLIWGPAVNPLFLKRARKVVVTHLGEVIPAND

SEQ ID NO: 9444 - protein, 136 aa, unidentified
  REGION 1..136: note = Description of Unknown:uncultivated organism sequence
AIFALLDERGREKRWDSIALSLFDAMERKRKGQPLIQTSYPDAGNYVFKFSLMGGDTVLLHKECNHKENLCNPSVWRLRTIASNGQLCLMRVNDARLIKAVKDAGDWWSPRVDALRKLDATKVVIDSLGRIHQAGG

SEQ ID NO: 9445 - protein, 129 aa, unidentified
  REGION 1..129: note = Description of Unknown:uncultivated organism sequence
EIVANLDAQGHEESWGGLLVSLYEATRRVDAGEPVVQRDHGPGKKFLFSLTGGEYVLMRQESGENHQLCRVVVITDGQVEFRLHTDARPSTVTKKSPGARIRVSPGAMKRRGARKVAVDPLGNILPAND

SEQ ID NO: 9446 - protein, 125 aa, unidentified
  REGION 1..125: note = Description of Unknown:uncultivated organism sequence
EIVATLGANGEEVEWKGEIVSLYEATQRVRAGLPVVQREQKEGRKFMFSLAKNEYFMMEIEPGKAALYRVVKISAGDIEFQLHCDGRPTIFEGRKRVRKSPGALQGVKARKVAVDPLGNILPAHD

SEQ ID NO: 9447 - protein, 134 aa, unidentified
  REGION 1..134: note = Description of Unknown:uncultivated organism sequence
ELFVHRDENRRESWTHVPVSLMEASRRSAANRRNGHAEAVVSQELKDDPEAEFLFSLMKGDIVEMDHEGGRELFRVKKFYAAGPIWFSHVNNAQKDADQKRDKTHWSKVPNGLMQLKARKVTIDLLGEVHPVHD

SEQ ID NO: 9448 - protein, 134 aa, unidentified
  REGION 1..134: note = Description of Unknown:uncultivated organism sequence
ELFMRRDEKGRERWTHVPVSLMEASQRNAANRRNSHLEAVVSRTMKDKPEAKFLFSLMKGDIVEMDHAGDRELFRVKKFYAVGQIWFTHVNNAQNDADQQRDRTRWSKSPNGLMQLDAHKVTIDLLGKVHPVHD

SEQ ID NO: 9449 - protein, 134 aa, unidentified
  REGION 1..134: note = Description of Unknown:uncultivated organism sequence
ELFVQRDENRRESWTHVPVSLMEATRRNAANQRNRQVEAVVSRTMKDDPEAEFLFSLMKGDIVEMDFDGGRDLFRVKKFYANGQIWFSHVNNAQKDADQKSDNTRWSKRPNALKPLNAQKVTLDMLGKVHPVHD

SEQ ID NO: 9450 - protein, 130 aa, unidentified
  REGION 1..130: note = Description of Unknown:uncultivated organism sequence
AIVAEMDTKGDIKRYVFSTVTMLEALERKRQGVPVVQREHGPGMQFLCTLSDGDMVEGKRPGDAVPRLWKVHTVDKNGRIFLSAALDARKKDEIKKAHDHWEPTVNSMFAAGGARKVLVTHLGEVIPAND

SEQ ID NO: 9451 - protein, 126 aa, unidentified
  REGION 1..126: note = Description of Unknown:uncultivated organism sequence
EIVASTDKRGKENWDISNIVSRYEAYLRLSAGEPIVKRNWNEGHELVLTLRRGDCLELDIVGIRQVMRVTSIGVDWIQTQPLSYGAPKMEKEERNSWLFRSGKGLQAANPRKVSISPIGEVRPCNE

SEQ ID NO: 9452 - protein, 136 aa, unidentified
  REGION 1..136: note = Description of Unknown:uncultivated organism sequence
EIFAKLDKRGKESGWEGIVISLMDAAERKRKGEPIVARTYGESDEYAFKFSLMGGDTVELHRNCDHASGKCSPSLYRLRTIAANGQLSLVRINDARLKDDIKKAKEWWSPMCGGLRKLDCRKVVVDLLGRVHPAND

SEQ ID NO: 9453 - protein, 134 aa, unidentified
  REGION 1..134: note = Description of Unknown:uncultivated organism sequence
TLFVSRKETGKAKKLREKWVSEYVSVLEAHRRHSAGLPVICKQYRNDPEAEFLCSLRKGDIVDLGPDDQRDYYILTSIEADGRINFVPITAAGKRAEQGSVRIREMADGLRPLNLKKVFIDLLGMPHFINEASQ

SEQ ID NO: 9454 - protein, 130 aa, unidentified
  REGION 1..130: note = Description of Unknown:uncultivated organism sequence
EFFARRDRKNREEWTHIPVSIIEAHVRYGRKNPVIAHAHPEDQNAEFVFSLMKGDTVEMDYNGSRDVFKVKKFYSSGQIWFTQINNAQKDEEQKKDKTAWSVNPNPLRLLNPQKVTIDPLGRKYGVNRAT

SEQ ID NO: 9455 - protein, 134 aa, unidentified
  REGION 1..134: note = Description of Unknown:uncultivated organism sequence
ELFVQRDENRRESWTHVSVSLMEASQRNAANRRDGEKRSVVSHQMKDDTEAEFLFSLMKGDIVEMDYQGGRELFRVKKFYAAGRTWFAHVNNAQKDADQKRDGTCWAKPPNGLMQLNARKVTIDLLGHVHPVHD

SEQ ID NO: 9456 - protein, 136 aa, unidentified
  REGION 1..136: note = Description of Unknown:uncultivated organism sequence
EVFAKLDAHGKEVRWDNIVVSLLDAVERKRQQVKVVQRSYRDTDDYIFKFSLMGGDIVQLHKNCDHAAGKCSPSLYRLRTIAANGQLSLISVNDARLKDEIRKVKEWWSPRCDALRKLDCQKVQIDLIGRVHPVND

SEQ ID NO: 9457 - protein, 131 aa, unidentified
  REGION 1..131: note = Description of Unknown:uncultivated organism sequence
EIYAEVDENGKEGTWGGDVVPTDEAYGRVKMRKPIIQRDHGPLAKFRFSLAPGEVIECDDGRGGRSLWVVRGATSQRESPRLFLVPINDAREKAEVVKSGLYWRPFLNPLRKLNARKVIVSPLGEVSEAHD

SEQ ID NO: 9458 - protein, 136 aa, unidentified
  REGION 1..136: note = Description of Unknown:uncultivated organism sequence
AIFAELDGHGKERRWEPITVSLYEAMNRKRSGLPVVQQAYPGAEDCVFKFSLMGGDTALLHRDCDHARDICRPRAWRIRTITQTGRVALVPINDARMKAEIKSSKDWWEPGIDALRKLGCEKVVIDTLGRPHVTSD

SEQ ID NO: 9459 - protein, 156 aa, unidentified
  REGION 1..156: note = Description of Unknown:uncultivated organism sequence
EFYRNDKGEFKESVISYWQAFLRIKNYLPLFVNIDNASILRKASEEGFDIGEIHDSSWNPFLCLGKTELVVIGLKKRTIENLIKRGDYSKIASHVYKVCGVSQGDYTFCIHNEIKYVPKERNKPDGRFIRIQNIKSLANLELVKVKINPIGEITIL

SEQ ID NO: 9460 - protein, 123 aa, unidentified
  REGION 1..123: note = Description of Unknown:uncultivated organism sequence
ELFVTRDTKRREKWDSRVVQITEAYERRRSKKAVVSRALADDAEAEFLFSLAKDDTFEIKDRDGRKIVRVKSFYDNKQIFYVPVNFAGIGRVEDESKKPNTLKPLEARKVVIDLLGRVHPAND

SEQ ID NO: 9461 - protein, 146 aa, unidentified
  REGION 1..146: note = Description of Unknown:uncultivated organism sequence
SFFNVQNRRGTKWKWDVVKLFDAAQSIQSVPKRERVRTNIFALPSEEFKKSLRDDDEVTYRFSLMKGDLVEMENGEIVIVRRFESDGRIWISAVNAAGTDKMLNETNSLHRIGLSDFLKKRPKDSDSPQPIRIDPIGNKSRIELGA

SEQ ID NO: 9462 - protein, 158 aa, unidentified
  REGION 1..158: note = Description of Unknown:uncultivated organism sequence
ALYRDAEGKLTEHVVSFWHAVERKKYGIPVVVEDTNALWDKIVNMDLPDAFMNNLPPAGLKLEVSIQQNEMFILGMAEEEYRRAMEEKDYKMLNKYLYRVQKIASKEYYFRFHIETVLDDSLEAMSIHKFYRVKSLGAFSNLHPHKVRVNILGEISEL

SEQ ID NO: 9463 - protein, 128 aa, unidentified
  REGION 1..128: note = Description of Unknown:uncultivated organism sequence
AIHEVQAENGPKWEATVVTLLEATERRRRGVPVIERVTDGSHRFICSLRSGDSVVVEIENEGDVFCTVNSVSGSKIEITRHADARLVSEIRKMGVKGGRLEISLKKLRSIFKDKADVLPDGSVRTRRD

SEQ ID NO: 9464 - protein, 128 aa, unidentified
  REGION 1..128: note = Description of Unknown:uncultivated organism sequence
AIHEVQAENGPKWEATVVTLLEATERRRRGVPVIERVNDGSHRFICSLRSGDSVVVEIENEGDVFCAVNSVSGSTIELTRHADARLASEIKKMGVKGGRLAISLKKLRSIFKDKVDVLPDGSVRTRRD

SEQ ID NO: 9465 - protein, 127 aa, unidentified
  REGION 1..127: note = Description of Unknown:uncultivated organism sequence
EIVAILYEKANETKWEGHIVSLYEAYQRKKKGEPLIKKDFGEGKLFKFSLSCGDYIELDDNGKRDIYLIRSIPESLQIQYVKPNDARKQKDRKTDKAWLSKYPEPMRKANCKKLTITPFGELRYAHD

SEQ ID NO: 9466 - protein, 131 aa, unidentified
  REGION 1..131: note = Description of Unknown:uncultivated organism sequence
EVFACKDKTGKAALRTHVVSRREAMQRLRQIRNSRQGTVIRRQDEEGNPLRFSLVIGELIKVKWKGEEVICLVQGISPDFYSIRRHSDARPETVIRQQRDRMIIQSDATFDKLVSDKLAIDPIGRTHVSHD

SEQ ID NO: 9467 - protein, 131 aa, unidentified
  REGION 1..131: note = Description of Unknown:uncultivated organism sequence
EVFACKDKNGNPAWRTHVVTRREAMRRLRQIRNSRQGSVIRRQDEEGNPLRFSLVIGDMVRMRYGNEMMTCRTQAISIRDYVFREHSDARDEKTVKQLKQRIRFRSDTALKDAVENKLAIDPIGRTHVSHD

SEQ ID NO: 9468 - protein, 129 aa, unidentified
  REGION 1..129: note = Description of Unknown:uncultivated organism sequence
VIVAVIKPNEVETKWEDYPVTRLEAHGRKTNGSLIIQRDWGVNRRFKFSLTANDYVQMKVGDNPSELCRLLSLSEGQFEFRVHTDARKASEARKAGSGARIRTSADELRKRSAMKVRITYLGDIVPAND

SEQ ID NO: 9469 - protein, 129 aa, unidentified
  REGION 1..129: note = Description of Unknown:uncultivated organism sequence
EIIETTDKRGNVKWEGSVVSRYEAMRRLQNREPVIKRDHGNGRKFLFSLALNEVVQMKDTEGVIRLYRIAGVSQFSTGTVVIDFRETGDARRAADVPREGRTRTPEAFRKSEPVKMCVTPLGELRRAND

SEQ ID NO: 9470 - protein, 130 aa, unidentified
  REGION 1..130: note = Description of Unknown:uncultivated organism sequence
AIFARLDADGAEVAWEAEVVSQLEAQRRLRSGEPVIRWETEPGRSFKFSLSPGDTIELELNGVRRLLHVRSVWMEGETGRIACVNLADARQIADLRKASSWFRPMLSGLRSGGCRKVEVSPLGEVFPAGG

SEQ ID NO: 9471 - protein, 129 aa, unidentified
  REGION 1..129: note = Description of Unknown:uncultivated organism sequence
EIIETTDKRGNVKWEGSVVSRYEAMRRLQNREPVIKRDHGNGRKFLFSLALNEVVQMKDTEGVVRQYRVAGVSQFSTGQIVIDVRELSDARRAVDVPREGRTRSPDTLRKSESIKFCATPLGELRRAND

SEQ ID NO: 9472 - protein, 141 aa, unidentified
  REGION 1..141: note = Description of Unknown:uncultivated organism sequence
EIFEVLGKDGNVTKWQGRVVTRLDACQRRKQGQPIVNRHWDESRRFLFSLTQRDVVEIDVETTPGGLRRELYIVRGVSMEKDGRLELMHIHDARRKADVPRSATDDEKVRIRIAPFVSSLKKRNCRKAMVTPLGEVYPAND

SEQ ID NO: 9473 - protein, 125 aa, unidentified
  REGION 1..125: note = Description of Unknown:uncultivated organism sequence
EIVETQNKNGEIIWEDHVVSLMEAVQRHKAGLPVIKRDHGPGSTFIYSLFKGDTCTITENDETIYCTVIGIAVGEVTLVRMYDARKQVEIRQTKSRIRCNANSLRKKQLRKLLITPLGEVIPAND

SEQ ID NO: 9474 - protein, 121 aa, unidentified
  REGION 1..121: note = Description of Unknown:uncultivated organism sequence
EIFAAYDENGKVKGLGRVVTVLEACERRCRGEPVISKDFTCEEQQKGKFSSIEFKFALFKNSLLKCRINGEEKTVRIIAISDNLIDAKEHYDARSTKEVREQGERIRLRYAVVCGVPGNNG

SEQ ID NO: 9475 - protein, 115 aa, unidentified
  REGION 1..115: note = Description of Unknown:uncultivated organism sequence
EVYAILDANGNELKYRVKAVSLLEAWERKRKGKPIICTNHGPGTRFKCVLRKGDYIKFVKDNRLLRVVSVSDNYIAGKDVNDGRKITDIKKNKELIVVCRKRMLWSAANERTGTP

SEQ ID NO: 9476 - protein, 130 aa, unidentified
  REGION 1..130: note = Description of Unknown:uncultivated organism sequence
AIFARLDADGAEVAWEAEVVSQLEAQRRLRSGEPVIRWETEPGRSFKFSLSPGDTIELELNGVRRLLHVRSVWMEGETGRIACVNLADARQIADLRRASSWFQPRLSGLRSGGCRKVEVSPLGEVFPAGG

SEQ ID NO: 9477 - protein, 127 aa, unidentified
  REGION 1..127: note = Description of Unknown:uncultivated organism sequence
EIFAAYDENGKVKGLGRVVTVLEACERRCRGEPVISKDFTCEEQQKGKFSSIEFKFALFKNSLLKCRINGEEKTVRIIAISDNLIDAKEHYDARSTKEVREQGERIRLRYNDLLLFCGGCGVPGNNG

SEQ ID NO: 9478 - protein, 133 aa, unidentified
  REGION 1..133: note = Description of Unknown:uncultivated organism sequence
EIFETKDKKGRTIWDANVVSMYTAMQRKRRGEEIIQRKLIRDGKVVEDAKFLFSLCKGDMVYMKNSDGEFEYYTVVTVSEYASGSKVMFFIQHFVAKRPKSWVGLTRYPTTLQISEAKKCSINVLGEVQIAHD

SEQ ID NO: 9479 - protein, 123 aa, unidentified
  REGION 1..123: note = Description of Unknown:uncultivated organism sequence
EIVEETRNGKTRWTGVMVDRLQAVSRKKRGEDVVQKDHGEGKKLVCTLAPKDTFYLKEENLYGIVRSVSNGNVEFISIFDSRKVLDLKKDSGVWRKRSVDALRDLGFVKVTVSPIGEATPCHD

SEQ ID NO: 9480 - protein, 124 aa, unidentified
  REGION 1..124: note = Description of Unknown:uncultivated organism sequence
AMYETTDDDGSIKWEAEVVSLYEAYRRKRSKEPVVHQESTERRRFLFSLSGGEIIELTRNGVANLFVVRSIEATGNIRFAPVKDARTLKEIGKKGLTALPEPLRKQGCLKLVVTPLGEVRTDNS

SEQ ID NO: 9481 - protein, 124 aa, unidentified
  REGION 1..124: note = Description of Unknown:uncultivated organism sequence
AMYETTDDDGSIKWEAEVVSLYEAYRRKRSKEPVVHQESTERRRFLFSLSGGEIIELTRNGVANLFVVRSIEATGNIRFAPVKDARTLKEIGKKGLTALPEPLRKQGCRKMVVTPLGEVRTDNS

SEQ ID NO: 9482 - protein, 133 aa, unidentified
  REGION 1..133: note = Description of Unknown:uncultivated organism sequence
EIFEVTDLQDPCNKRWECEVVDTLGAMDRLRKGQPVVRKEAEGKRFLFSIATGDTLKLHNPGEWPEYLHVRKVSKTLDGRMEIAGVSINDARLKKDIVNTKEFYRIASVIKLQNLDPQKVTVLPCGEVLVAKG

SEQ ID NO: 9483 - protein, 125 aa, unidentified
  REGION 1..125: note = Description of Unknown:uncultivated organism sequence
AIFAKLDADGNETGWEGEIVTLMDARYRLLHHQPLFERNRPGMKFKFTLKKGDIVTFVKDGVERLCIIRGVSLPTFYCCPVRDARMQRELKAAKVWFWPTPSAAFQWKMTKYTMNLFGELRRAND

SEQ ID NO: 9484 - protein, 118 aa, unidentified
  REGION 1..118: note = Description of Unknown:uncultivated organism sequence
AIYSTIDKKGAPKQVGFVVPMIEVARRVKDGEPMVDRTYLPNHTFLYSLSKNEMIINHEDEEIYRVQKLASNGQIVFRRTSVALKGQNDPGVLRKNPGTLKATKIKISPIGEVFPASD

SEQ ID NO: 9485 - protein, 132 aa, unidentified
  REGION 1..132: note = Description of Unknown:uncultivated organism sequence
EIYARLDDRGNEVEWGGDVVTMYEAFQRVKAHRPIVEQDHGSLVNFKFSLAPGEVIECDGKGDGRGLFVMRKASQLSAGQLSIGFAPLRDARKAREIQESKAWLWANPDTLRQRNPRKVVISPLGEVNEAHD

SEQ ID NO: 9486 - protein, 121 aa, unidentified
  REGION 1..121: note = Description of Unknown:uncultivated organism sequence
CIFEFDERGRKKREAVWVSMIEAARRVREREPLIQREHPMRKDATFLMSLAPGEMVLGTFKGHERLCVFQTGASTQGQLYFAEHTDARKSGDREKFAVTASTLAARKVTVDPLGRIRWAND

SEQ ID NO: 9487 - protein, 118 aa, unidentified
  REGION 1..118: note = Description of Unknown:uncultivated organism sequence
FLYENTETGKWRLHIVTRFDAFLNRGKNLEDARAEYAGEGEEFLFSVTIGAAMMLEVDGEEELHFVRSIALSVKSLDLRPAATTSSGKLVWYGGSKLKNLKAHKVVVLPNGAVRTARD

SEQ ID NO: 9488 - protein, 121 aa, unidentified
  REGION 1..121: note = Description of Unknown:uncultivated organism sequence
QVFHSDTEKSPQFRVLSRFEASQRGTGLAAPTGFTLAATLHRKDSVLVEVDGLEEPVHAVIQMISGPSEIGTAGLDVTLRDARDSRKAGDARGSELMRIKSAARWKACRIRPLGIDPMGLV

SEQ ID NO: 9489 - protein, 147 aa, unidentified
  REGION 1..147: note = Description of Unknown:uncultivated organism sequence
EIRVKANKNGEIKWSGEVITNFDAARRVRAGKKPIVDRNENKNGKFVMSLARGEMVYMKHPETQKPNYFVVFKIDSSKAIHFTPHTDANPASSKKKDVKLREDIRLPGKKTGGLTVSQLQGLGVERGKWPEKVHIGPLGDVKVLVRD

SEQ ID NO: 9490 - protein, 135 aa, unidentified
  REGION 1..135: note = Description of Unknown:uncultivated organism sequence
EIRENLQTGKWSGRVVTMFKAAQRVRVHKVEALDRSDGQCRRFVMSLAEGETVHMRHPKTGQPGYFVVFKLDKPQTVHFIHHWDARPSKATQDQPPREDIALPASKIRSLGVQPSKPPCKVRIDPLGQVRPVHHD

SEQ ID NO: 9491 - protein, 165 aa, unidentified
  REGION 1..165: note = Description of Unknown:uncultivated organism sequence
CIYEFMHKGKKKRDAVFVTQLEATNRLKRQQQELAKRIEQWKRDGLDKREIKQRQSKAMREIAAEYPLIQRDASKLTGDDRNRIPANASFVMSLAQGELVLADWKGEQKILKFKTAASTQGQIYFALHTDARKSSEYTKHVATANSLSARKITIDPLGRIRWASD

SEQ ID NO: 9492 - protein, 181 aa, unidentified
  REGION 1..181: note = Description of Unknown:uncultivated organism sequence
EIRAAKSKKGEETWSGEIVTAFEVAQRKLAKLRAFRKAGIPKPDAFRKLLRAERAKLTPTLRAIEAAHPLVDRCDNDAKGGKFIMSLCEGEMLLMKHKVGGEVGYFVVAKLDKPQSIVLVPHWDARAAGERKDSEGTKVPDSKRDQFAATPGDLKSLAPPGRAHAIKVCVSPIGAVTEVCD

SEQ ID NO: 9493 - protein, 140 aa, unidentified
  REGION 1..140: note = Description of Unknown:uncultivated organism sequence
EIREKVTKKGEIRWSGDVVTNFDAAKRVRTNNEPIIDNGENEKAKFVMSLSRGEVVHMRHPETREVDYFVVFKIDGTGAIHFTRHTDANPASSKEKGVKLREDIALVPDKLRENIMFDERDVPEKVRISPLGEVKVLVKD

SEQ ID NO: 9494 - protein, 209 aa, unidentified
  REGION 1..209: note = Description of Unknown:uncultivated organism sequence
RIFEWVEKNKKGEDELVREVFFTTQLEVNRRNVERYRLIRSQMRDLPAELLQDERELKIREILRNAALQFPIIERTLSQEESLGHDAEKAVFVMSLSKNETLEITDIEVDKLTEDNPKTTLVLFKTGAATSKQLFFSDIRSGFKKPKKSEGEETNEETDSGDELLEEEEQNSSFGKYGKNAVERFSVSLKRIYRKVHIDILGNIYPAGD

SEQ ID NO: 9495 - protein, 177 aa, unidentified
  REGION 1..177: note = Description of Unknown:uncultivated organism sequence
EIREDPKTGKWSGEIVTAFEAARRNAARLQAIRRAGVPPAEQLRSMPRHERERFGDVVADINRRFPVVDRSDNDKGRFVMSLAEGETLHMRHPDTDQAGYFVVFKLDKPNTIHFIHHWDARPSQPRKDDDGKPIPNSQREDIRVVASRLKTLGVEPGQPPYKVRVSPVGEVTRLTGD

SEQ ID NO: 9496 - protein, 182 aa, unidentified
  REGION 1..182: note = Description of Unknown:uncultivated organism sequence
EIRVAKNKKGVEKWSGQIVTTFEAAQRKLAKLREFRKANIPKPVEFKKLTKADRAKLTPTLRRIEQDHPIVDRNDDDAKGGRFVMSLSEGETLLMKHKDAGEVGYFVVAKLDKPQGIVLVPHWDARAAGERKDSEGNKVPDSKRDSFTATPNDLTTLAPPGHPHAVKIHVDPLGQATVLERD

SEQ ID NO: 9497 - protein, 182 aa, unidentified
  REGION 1..182: note = Description of Unknown:uncultivated organism sequence
EIRVATDEKGQEVWSGEIVSAFDAAQRKLARLRALREAGIAKPEDLRRLAEPERRRLAPVLRSIEAAHPLVDRRDDDARGGRFVMSLCEGETLYMKHKQTGETGYFVVAKLDKPHSIVVVPHWDARAATERKDAEGRKVPNSKREQFAVTPSDLKALAPPGYDHAVKVRVSPLGKVTVLQRD

SEQ ID NO: 9498 - protein, 121 aa, unidentified
  REGION 1..121: note = Description of Unknown:uncultivated organism sequence
CIFEYSENGKTKRDAVFVSMLDAITRLKRREPVVQRTHPTRADAKFLMSLSRGEMVVATFQGKERLVCFRTAASTQGQIYFVAHTDARTSADTKKLVAKASTLKARKVTVDPIGRIRWAND

SEQ ID NO: 9499 - protein, 121 aa, unidentified
  REGION 1..121: note = Description of Unknown:uncultivated organism sequence
EVFEFRRGPRTLRQGRFVSLLEATQRLRARQPIVQRTWPEHPDARFVMSLCPGDMLLPRWDSSERLLLVSTLVSTQERIHIVDARDARPSSKRCDVGKTPNSLQAIKVTVDPIGRIRRAGD

SEQ ID NO: 9500 - protein, 143 aa, unidentified
  REGION 1..143: note = Description of Unknown:uncultivated organism sequence
EIRQDAHGRWNGQIISMFAAARRVRHEKRPAVDRSDNPDLGGEFVMSLAAGETVCMLDEETGQAGYFVVVKLDKPHTIHFIRHWDARRATGEKDADGTLRPGSQRVTIDKTASQLRDLAPPGHDFPFKVRVSPLGEVMPLLKD

SEQ ID NO: 9501 - protein, 121 aa, unidentified
  REGION 1..121: note = Description of Unknown:uncultivated organism sequence
EIFEFHQGSRTFRRGRFVSLLEATQRLRARQPIVQRTWPEHPDARFVMSLCTGDMVLARWDGSERLVLVSTLVSTQERIHIVDARDARPSSKRCDVGKTPNSLQAIKVTVDPIGRIRRAGD

SEQ ID NO: 9502 - protein, 181 aa, unidentified
  REGION 1..181: note = Description of Unknown:uncultivated organism sequence
EIRAAKNKKGEEVWRGEVVTAFQVAQRKLAKLRAFRQAGVPRPDVFRGLPRAERARLMPVIRAIEKDYPLVDRSDDETKGGRFVMSLCEGETLLMKHKATGEVGYFVVAKLDKPQGIVLVPHWDARAAGERKDAEGKTVPDSKRDQFTATPTDLLKLAPPGRPHAVKVRVSPLGEVREVHD

SEQ ID NO: 9503 - protein, 142 aa, unidentified
  REGION 1..142: note = Description of Unknown:uncultivated organism sequence
EIREDANGKWTARIISTFDAARRVRPPKNADGTRPEPQPAVDRSDNDDRTFVMSLAEGELIYARRKDRPAESPDYYVVCKLDKAGNSCRIHFAPHWDARKASEQDRWDVMPGDLKNCGPHPGEPPCKVRVGPLGDVTRLKRD

SEQ ID NO: 9504 - protein, 123 aa, unidentified
  REGION 1..123: note = Description of Unknown:uncultivated organism sequence
TIFEWEANGKTKREAVFVTQLEAIRRIAKGIEVIQRNPPQDHPTIPSDARFVMSLSRGEMVLATIGEEEKLLVLVTAVSTSKQLRFAEHTDGRRQRIWRFSPNTLQARKVTVDPIGRIRWAND

SEQ ID NO: 9505 - protein, 142 aa, unidentified
  REGION 1..142: note = Description of Unknown:uncultivated organism sequence
EIRENPKGKWVGDVIPTFDAVRRVRPPKAPGQKPRPAVDRSDTKKGKFIMSLCIGETVYMKHKDSEKPGYFVVFKVDSGKSGRIHFTHHWDAGKDKADETHPARADISLSPSQLQALGAEEGKPPVKVWVSPLGKVKVLHRD

SEQ ID NO: 9506 - protein, 118 aa, unidentified
  REGION 1..118: note = Description of Unknown:uncultivated organism sequence
FLYENTETGKWRLHIVTRFDAFLNRGLSLSETRAVHAEEDEEFLFSVTIGAALLLEMDGKDELFFVKSLAPSLQSLDMRPASTTAGNKNIWFRASKLQKFKARKVVVLPNGEVRTARD

SEQ ID NO: 9507 - protein, 136 aa, unidentified
  REGION 1..136: note = Description of Unknown:uncultivated organism sequence
EIRENEKGKWLGEVITNFDAARRVRADKKPIVDRNENKNGKFVMSLARGEMVHMKHPNTQEANYFVVFKIDSSKAIHFTPHTDANPASSKKKGVKLREDISLVPDDLRQNIIFNEDGVPEKVKVSPLGKVKVLVKD

SEQ ID NO: 9508 - protein, 134 aa, unidentified
  REGION 1..134: note = Description of Unknown:uncultivated organism sequence
EIRENCKTGIWSAEIVPTFEAARRVRVEGRAAVNRSDDDDARFVMSLAEGEMIHARRNDRPDERPDYFVVCKLDKLGSSSRIHFAPHWDARKASEQDRWDVTPADLKECGPEPGKPPVKVRVGPLGDIKVLERD

SEQ ID NO: 9509 - protein, 125 aa, unidentified
  REGION 1..125: note = Description of Unknown:uncultivated organism sequence
CLFEWEEKGKVKRDAEYVSRLEASRRLRDREPLIRRTHSEVPHARFLMSLCPGDTVLVDVDGQSRLMVVSTLVSTQKRIHLVDSRDARRSSDRLDIGLSPNSLIEKYHARKVIVDPLGRIRWAND

SEQ ID NO: 9510 - protein, 188 aa, unidentified
  REGION 1..188: note = Description of Unknown:uncultivated organism sequence
EIRVSKDKHGKDIVRGQIVSAFEAAQRKLARLRAIRMAGVPKPSKLRRLPKKERLQWRTVLKSIDAANPIVDRRYDDAKGGQFLMSLCEGETLWLRQKPRKKGDPCGDASYFVVAKLEKGDNAVLVPHWDARAAGEQKDSSGNKVPNSKREQFSITPSDLKTLAPPGHPFAVKVRVSALGKVTVLKND

SEQ ID NO: 9511 - protein, 142 aa, unidentified
  REGION 1..142: note = Description of Unknown:uncultivated organism sequence
EIREDSRGRWSGRIVSTFEAAQRVRPAANPDGSKRPAQPAVDRASNAAGDFVMSLSEGEMMFARRKDRPDGPADYYVVCKLDKAGNSCRIHFAAHWDARKAAEQDRWAVAPADLKACGPRPQAPPEKVRVGPLGGISVLVRD

SEQ ID NO: 9512 - protein, 122 aa, unidentified
  REGION 1..122: note = Description of Unknown:uncultivated organism sequence
CIFEEKKQGKTRWYANYVTMLEAARRVRQHEPIIQRADAGNPDARFVMSLCKGDLLLTEYQDNERLVVVSTMVTTQKRIHVVDANDARPGAKKKDIGKTANSLKGARKANVDPLGRVRWAND

SEQ ID NO: 9513 - protein, 202 aa, unidentified
  REGION 1..202: note = Description of Unknown:uncultivated organism sequence
EIRVSRDKKKREVWTGVIVSAFDAAQRKLEKLRAFRQAGIPKPTAFRALSQPERDRLSPILRSIELAHPIVDRRDDDSKGGCFVMSLCEGEMLFMKHKERDELGYFVVAKLDKPNRIIVVPHWDARAAGERKDAEGNKVPDSKRESIALTPSDLLTLAPPCYPTRSGKPPTRPGGSPWSDAPPHALKVRVSALGVVTVLDRD

SEQ ID NO: 9514 - protein, 124 aa, unidentified
  REGION 1..124: note = Description of Unknown:uncultivated organism sequence
AIFELPDGKRVPLFVTMLEAAKRARQKGPNGQTVSIVQRNHPDYPEARFIMSLSSTELLLANWKGQSRLLQFRTCAQTQGQLYFADARDARPASQKEKFVANANTLDARKVTVSPLGELRWAND

SEQ ID NO: 9515 - protein, 140 aa, unidentified
  REGION 1..140: note = Description of Unknown:uncultivated organism sequence
EIRQKTSKNGEIKWTGEVISNFEAARRCRTDGSGIVNRADSHNGQFVISLARGEIVHMNHPNTGRSDYFVVFKIDRTGTVHFTAHTDGNPASSKDKKVKLREDIALVPNDLHKYMIFTEDGIPEKVRISPLGEVRVLERD

SEQ ID NO: 9516 - protein, 121 aa, unidentified
  REGION 1..121: note = Description of Unknown:uncultivated organism sequence
EVFELELGGKTKRYGRFVTRLEAYRRIRNRIQLVQKTDPENPAARFIMSLCTGDMLWAEFDGQERLVVVQTLVSTQPRAHIVDANDARPSTKKRNVGKRIGALRARKVTVDPLGRIRWAND

SEQ ID NO: 9517 - protein, 135 aa, unidentified
  REGION 1..135: note = Description of Unknown:uncultivated organism sequence
EIRESIKGQWNGDVITNFDAAKRARVDKKTIVDRNDTESGRFIMSLAKGEVVSMRHPATQNANYFVVFKIDSTGTIHFTKHTDANPASTKKKNVPIREDIDLTPQKLQKLGVAPGSVPYKVKISPLGEVRELIRD

SEQ ID NO: 9518 - protein, 140 aa, unidentified
  REGION 1..140: note = Description of Unknown:uncultivated organism sequence
EMREKVNKKGEVKWSGEVITNFDAARRVRAEKKPIIDRNENKNGKFVMSLARGEMVHMRHPDTKEANYFVVFKIDSSKAIHFTAHTDANPASSKQKGVKLREDIPLVPDMLRQHIIFSENGTPEKVRISPLGEVKVLISD

SEQ ID NO: 9519 - protein, 133 aa, unidentified
  REGION 1..133: note = Description of Unknown:uncultivated organism sequence
EIRENNKGKWVGEVITNFDAAKRVRTDKKPIVDKNENKNGKFVMSLARGEVVHMKHPDTQEANYFVVFKIDPSKSIHFTKHTDANPASKGVKLREDVPLVPDKLRQNIIFDKDCVPEKVKISPLGEVKVLVKN

SEQ ID NO: 9520 - protein, 146 aa, unidentified
  REGION 1..146: note = Description of Unknown:uncultivated organism sequence
EVRENEKGKWIGEVITNFDAAKRVRVKQPKQKPQGWTPPPAVNREDTKKGRFVMSLSRGEVVHMRHPETQKAGYFVVFKIDPSKSIHFTPHTDANPASSKKKGIKLREDIPLVPDALRQSIIFNENGVPEKVKISPLGDVKLLVRD

SEQ ID NO: 9521 - protein, 140 aa, unidentified
  REGION 1..140: note = Description of Unknown:uncultivated organism sequence
EIREKTGKKGNVKWSGEVITNFKAAKRARIDKTAIVDKNENKNGKFVMSLSKGEIVHMKLPEKKGADYYVVFKIDPSKTVHFTPHTDANPASSKKKGVKLREDIALVPNDLRQNIIFNENNVPEKVKISPLGEVRVLVND

SEQ ID NO: 9522 - protein, 113 aa, unidentified
  REGION 1..113: note = Description of Unknown:uncultivated organism sequence
AVYRLESGSLSISVASLWRVCTSGHPSPPNHATELLFTLAPGDVFQTVDDGGVPEYWRVTDLDGANRRLGATLHWVDGREKGARQVFTAKRLKDACASKVVVSPSGLVRTARD

SEQ ID NO: 9523 - protein, 187 aa, unidentified
  REGION 1..187: note = Description of Unknown:uncultivated organism sequence
EFRVAPQPDGTEIWSGKIVTAFEVARRKSQRLRAFRQAGIPKPGDFRKLPKSQRAQFKPTLRAIEAAYPLVDRSNDDAKGGEFVMSLAEGEMLMMKHKVTGKLGYFVVAKLEKRGGNNRDCAVLVPHWDARAAGERKDAEGKRVPDSKREQFTITPVDLKLLAPPDHPHAIKVRATPLGDVYPLQRD

SEQ ID NO: 9524 - protein, 149 aa, unidentified
  REGION 1..149: note = Description of Unknown:uncultivated organism sequence
EIRERIRQRGGQAVAEWIGEVVTTMDAARRLHPPRNPDGTRPEPRPAVDRSDNHDGVFVMSLAEGETIYARRKDRPEEPASYFVVCKLDKAGNSCRIHFAPHWDARKASEQDRWAVTPGDLRLCGPEPDRPPYKVQVGPLGDVKRLEKD

SEQ ID NO: 9525 - protein, 134 aa, unidentified
  REGION 1..134: note = Description of Unknown:uncultivated organism sequence
EIRQNRRRGRWSGVIIPTFEAARRVRLERRDAVERVDNDDSDFVMSLAEGEMIYARRKDRPPDDPAAVGYFVVCKLDKPARIHFAPHWDARKASEQDRWDVTPGDLKNCGPEPGVPAYKVRVSPLGEVRRLEHD

SEQ ID NO: 9526 - protein, 132 aa, unidentified
  REGION 1..132: note = Description of Unknown:uncultivated organism sequence
QVIDTIEGPHPQFRVVTRFDANQPGDWMSLPLGASLIGTLHRKDSVLISVPGLDEPVLCVIQLISGSSEVGTKGLSIVIRDARDSRPATEGNKKPLARLRSHGAWNGAAVRSVEVSPLGVLASDQTALVASP

SEQ ID NO: 9527 - protein, 127 aa, unidentified
  REGION 1..127: note = Description of Unknown:uncultivated organism sequence
EIFEYTDAKGNLKRNGKVISMFEAVQRSRQGKPVIYRDYGDGKRFVCSLAKNEMFMLEVEEGRHILHRVQKFGEVGGTIIIVLRPHTFAGKVNDSDKPPYIQRKTPNTLKGYKVTIDPLGRIFPAKD

SEQ ID NO: 9528 - protein, 123 aa, unidentified
  REGION 1..123: note = Description of Unknown:uncultivated organism sequence
EIFEYTNETDKSGRPRRDAVVVSLFDAVQRSKRGEPVVCRDHGPGTRFVCSLAINEMVLMDNGSGEMDLYRVQKMDVSKTVYFRQHTAATLEDEGTLIRKAAHVFEGYKVVVDPLGRVYRAND

SEQ ID NO: 9529 - protein, 132 aa, unidentified
  REGION 1..132: note = Description of Unknown:uncultivated organism sequence
AIMGPTPNEGRLVVNVADFSAMSLAKRTALFRNARVVYRRGDMITSLGSPFVVTGLTADGRLIAYTADVAQRDKQQKHLLTVPSGIEGKDSNPKTSKPILNKLSIDVLGRRLHRLRKTPGGLAPMPYPLREQ

SEQ ID NO: 9530 - protein, 124 aa, unidentified
  REGION 1..124: note = Description of Unknown:uncultivated organism sequence
EIFEYADAKGNTKRDGKVISMFEAVRRSRQGLPVVCRDYGDGKKFVCSLAKNEMFMLEVEQGCHTLHRIQKLDVNGGIVLRPATFAGQLDNKDKPPYIQRKTPNSLRGYKVTVDPLGRIFPAKD

SEQ ID NO: 9531 - protein, 118 aa, unidentified
  REGION 1..118: note = Description of Unknown:uncultivated organism sequence
AIYETTDDKGQKKQVGIVVPMMEAARRVKDGEPIVMKDYRPDHSFLFSLAINNSVMNKEDGEIYRVQKIASGGQITFRSNAVALKGQSDPGVLRKNPSALSMNKIKISPVGEIFPAND

SEQ ID NO: 9532 - protein, 145 aa, unidentified
  REGION 1..145: note = Description of Unknown:uncultivated organism sequence
ALYRNEKGKYLTELVSVWTAVVRKQNDLDIICRNHPEGLKFITCFQQNEMFIYELSPEQVQEAIDRKDRKLLSKYLYRMQKISKKESGGIEVGFRHHLETKIDDSETAKKIKKFFIVQGVETLLKFTKVKINHLGQITKIFAEGE

SEQ ID NO: 9533 - protein, 162 aa, unidentified
  REGION 1..162: note = Description of Unknown:uncultivated organism sequence
AIYRDADGNKHEHVVTFWDAFQRVRLGLPAIITDVPAALQYAQDQLPEGVTDLLLPEGWDWQFVVSLAQNDMFVFDLDPSEINFTDPNNRARISKHLFKVRKLSANDYSFLHHLETEIVDDLVSKSINRCKRCSMSALSRSRAVKVKINRLGHVVEVGQPFS

SEQ ID NO: 9534 - protein, 160 aa, unidentified
  REGION 1..160: note = Description of Unknown:uncultivated organism sequence
AIYRDADGNKHEHVVTFWDAFQRVRLGLPAIITDVPAALQYAQDQLPEGVTDLLLPEGWDWQFVVSLARNDMFVFDLDPSEIDFTDPNNRARISRHLFKLRKASKKQYWFLHHLETEVLEDLASKKAYRCKQCSMESLAGAVKVKINRLGHVVEVGQPFS

SEQ ID NO: 9535 - protein, 141 aa, unidentified
  REGION 1..141: note = Description of Unknown:uncultivated organism sequence
AIYQRPDGSRFHRIVTFWEAVERINQGQPLYQPTIEDGQLLLTLSANDMFVFELDPDEIDFTNPANYGLISRHLYRVQKMTGDDRKLDIWFRHHLDPTTEHRKPYGEMGNFRRITSLSKLVGTKVWLDQTGRIVQHLRCIG

SEQ ID NO: 9536 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPESAMAKPPLEIYFGDLVQIGDFIGRFSGYNINNANWSFTDRLTRLNLSCPTVGQLNNDLSPVVIRESPIK

SEQ ID NO: 9537 - protein, 142 aa, unidentified
  REGION 1..142: note = Description of Unknown:uncultivated organism sequence
HAVFDKDRGKSGRWLFDPIYYVDIPHLSKDRMRVFSKDKAIDYWETTEIDPESPQLMIKMGDVLLQDGRAMRFYNFNVATGGICSYVTGAPHKSLQKTGPLSCESFPTPMKWASDLKIMHEDSLGLCWLRFLVARTESCDGA

SEQ ID NO: 9538 - protein, 121 aa, unidentified
  REGION 1..121: note = Description of Unknown:uncultivated organism sequence
RLWHDPDAKKGKGCWYADPVYKADIPALKDGSYVPRIAKAHSGRKAWKPVPESALKGGTIEIYLGDIVRIGDFIGRFSGYDINSANWSFVDRLTRNPIKCPTVGKLNNLIIPIVTRENIVE

SEQ ID NO: 9539 - protein, 145 aa, unidentified
  REGION 1..145: note = Description of Unknown:uncultivated organism sequence
HAVFDKDSGKSGRWLFDPIYYVDIPHLSKDRMRVFSKDKAIDYWETTEIDSESPQLIIKMGDVLLQDGRAMRFYNFNVATGGICSYVTGAPHKSLQKTGPLSCESFPTPMKWARDLKIMHEDSLGLCWLKFLTDRTDRCALESIQ

SEQ ID NO: 9540 - protein, 123 aa, unidentified
  REGION 1..123: note = Description of Unknown:uncultivated organism sequence
RLWHDPEAKKGQGAWYADPVYKADIPALKDGTYVPRIARAAIGRKAWKLVPKSAMTKPPLEIYLGDLVQIGNFIGRFSGYNIANGSWSFIDRLTKEALSCPSVAKLNNNLFPTIIRESIIMRK

SEQ ID NO: 9541 - protein, 143 aa, unidentified
  REGION 1..143: note = Description of Unknown:uncultivated organism sequence
RLWLDPTARPNGKVKGKWYAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 9542 - protein, 143 aa, unidentified
  REGION 1..143: note = Description of Unknown:uncultivated organism sequence
DAVFDASAGKRGRWSFDPVYCIDIPHRDAERRTIRAFSKEKAIDLWDTVEVPEAAPRMTIRRGDVLVCDGKAARFHCFDISVNAIRLFSQRGGKQLQATGPLSAEAFPPPSKWGEGVRVMQEDCLGLCWLSFLAQRAADMQSE

SEQ ID NO: 9543 - protein, 143 aa, unidentified
  REGION 1..143: note = Description of Unknown:uncultivated organism sequence
RLWLDPTARPNGKVKGKWHAEPVYYADIPAIKAGTYVPRAIVQGIARINWEPIPQTALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 9544 - protein, 123 aa, unidentified
  REGION 1..123: note = Description of Unknown:uncultivated organism sequence
RLWHDPEAKKGQGAWYADPVYKADIPALKDGTYVPRIARAAIGRKAWKLVPKSAMTKPPLEIYLGDLVQIGNLFGRFSGYNIANGSWSFIDRLTKEALSCPSVAKLNNNLFPTIIRESIIMRK

SEQ ID NO: 9545 - protein, 145 aa, unidentified
  REGION 1..145: note = Description of Unknown:uncultivated organism sequence
AGVFDRTLKKSGSWRFDPIYYIDVPNVRQDFIRDFSKALSIDYWPKVQLKGNEPRIFLKQGDVLLQDGCAMRYYMYDVSYGGVKSYSRIGKESISLQKTGPLAEEPFPKQMKWDSSLTVMQEDCLGLCWLRFLSDRADQFENSPV

SEQ ID NO: 9546 - protein, 136 aa, unidentified
  REGION 1..136: note = Description of Unknown:uncultivated organism sequence
LAVYEESAARWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 9547 - protein, 136 aa, unidentified
  REGION 1..136: note = Description of Unknown:uncultivated organism sequence
LAVYEESASRWLFDPLYYIDVQKRKTEEPFIRKFSKDLSIDYWEKIPLTGNEPSLLLKRGVVLIQDGIVGRYYGYDIAHNNVKLSPSGKVSFQKTGPLAAEKFPTPTKWTDELRIMQEDCLGLCWLEFLTERANHC

SEQ ID NO: 9548 - protein, 143 aa, unidentified
  REGION 1..143: note = Description of Unknown:uncultivated organism sequence
EAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQTTGPLSAEAFPPPSKWGEGVRIMQEDCLGLCWLSFLAQRAADVQME

SEQ ID NO: 9549 - protein, 121 aa, unidentified
  REGION 1..121: note = Description of Unknown:uncultivated organism sequence
RLWHDPEAKKGQGCWYADPVYKADIPALKDGTYVPKIAKAHTGRKAWKPVPESAMKHAPLEIYLGDLVKIDDFIGRFSGFDINSANWSFSDRLTRQKLNCPTVGRLNNALLPTIIRESTID

SEQ ID NO: 9550 - protein, 142 aa, unidentified
  REGION 1..142: note = Description of Unknown:uncultivated organism sequence
DAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMPEDCLGLCWLSFLSNRAIAQMD

SEQ ID NO: 9551 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 9552 - protein, 121 aa, unidentified
  REGION 1..121: note = Description of Unknown:uncultivated organism sequence
RLWHVPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPTVGQLNNDLSPVVIRESPIK

SEQ ID NO: 9553 - protein, 123 aa, unidentified
  REGION 1..123: note = Description of Unknown:uncultivated organism sequence
RLWHDPEAKKGQGAWYADPVYKADIPALKDGTYMPRIAKAHTGRKAWKPVPESAMTKPPLEIYLGDLVQIGDFIGRFSGYNIANANWSFVDRLTKEALGCPTVVKLDNKLAPVIIRESIIMRH

SEQ ID NO: 9554 - protein, 135 aa, unidentified
  REGION 1..135: note = Description of Unknown:uncultivated organism sequence
RLWLDEEGKSGRGEWLIEPVYFADLDKIKRGSYVPRYIPRQKVTTQEWESIPSRITENSIPIVLRNDDIVRIDGIYGRLSGLDINSKRLKFDRILSKDVKTIGSWTKDTSVEVIHEDCLGLMWFNLLKDQNSKES

SEQ ID NO: 9555 - protein, 141 aa, unidentified
  REGION 1..141: note = Description of Unknown:uncultivated organism sequence
RLWLDVNAREGKGEWLIEPVYFADLQSIKKGTYIPKYIATYNATNDEWKPVPDDVLSKNKPLIVHRQDVIKVDSSFFRVNSVDIAKKTLKLIPVFYDSKNSNPELMITRKWDKSTKIELVYEDVLGMIWFNYLKNQNSSES

SEQ ID NO: 9556 - protein, 145 aa, unidentified
  REGION 1..145: note = Description of Unknown:uncultivated organism sequence
MAVFDESMKKSGSWRFDPIYYIDVPNVRQDFIREFTKGLSIDYWPKVQLKGDERRIFLKQGDVLLQDGCAMRYYMYNVSNGVVNSYSKIGEKSVPLQKTGPLSDESFPKQAKWDSSLTVMQEDCLGLCWLKFLSDRVGQFENSPV

SEQ ID NO: 9557 - protein, 122 aa, unidentified
  REGION 1..122: note = Description of Unknown:uncultivated organism sequence
RLWHDPEAKKGQGAWYADPVYKADIPALKDGTYIPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 9558 - protein, 120 aa, unidentified
  REGION 1..120: note = Description of Unknown:uncultivated organism sequence
RLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTLIRELLI

SEQ ID NO: 9559 - protein, 120 aa, unidentified
  REGION 1..120: note = Description of Unknown:uncultivated organism sequence
RLWHDPEAKKGQGAWYADPVYKADIPALKDGTYVPRIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 9560 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPESAMKKPPLEIYLGDLVQIGDFVGRFSGYNIDNANWSFVDRLTRIKISCPTVGKLSNDMSPFVVRESPIK

SEQ ID NO: 9561 - protein, 121 aa, unidentified
  REGION 1..121: note = Description of Unknown:uncultivated organism sequence
RLWHDPEAKKGKGAWYADPVYKADIPALKDGTYVPRIAKAHTGRKAWKPVPGSAMKKPPLEIYLGDLVQIGDFVGRFSGYNIDNANWSFVDRLTRIKISCPTVGKLSNDMSPFVVRESPIK

SEQ ID NO: 9562 - protein, 143 aa, unidentified
  REGION 1..143: note = Description of Unknown:uncultivated organism sequence
RLWLDPTARPNGKVKGKWYAEPVYYADIPAIKAGTYVPRAIVQGIARINWEPIPQMALESKPLVLFKNDVLVVDGHIARYSNIGISVCQLLMLNLLTRDRVTDWPSVGSWGKDTQVRILQEDCLGHCYDSIAINPEDSTFQQR

SEQ ID NO: 9563 - protein, 123 aa, unidentified
  REGION 1..123: note = Description of Unknown:uncultivated organism sequence
RLWHDPEAKKGQGAWYADPVYKADIPALKDGTYVPRIARAAIGRKAWKLVPDSAMTKPPLEIYLGDLVQIGNFIGRFSGYNIANGSWSFIDRLTKETLSCPSVAKLNNNLFPTIIRESIIMRK

SEQ ID NO: 9564 - protein, 142 aa, unidentified
  REGION 1..142: note = Description of Unknown:uncultivated organism sequence
RLWFDPDAKGRGGKKGRWYSDPVYKADLGVIQSNAYIPRVAKAHRGRKAWSPVPQAALRRSPVVIYLGDVVKVGDVVGRFAGFDIDSANWSFVDCLDGKGIAFPTVGSLTSELRPEVIREKVLGNAEVYRSTQDDGTSSGAD

SEQ ID NO: 9565 - protein, 122 aa, unidentified
  REGION 1..122: note = Description of Unknown:uncultivated organism sequence
RLWHDPEAKKGQGAWYADPVYKADIPALKDGTYVPRIAKQNYGRKVWKAIPHSLLIQKPLEIYLGDLIRVGDKLGRYNGYNIAKANWSFVDALTKKEITFPSVGMLSNELRPIVIRESILDN

SEQ ID NO: 9566 - protein, 140 aa, unidentified
  REGION 1..140: note = Description of Unknown:uncultivated organism sequence
RFWHDPDAGKNGKWYAEPVYCADIPAIQNGSYVPKYQKQKVARNSWLPVPDSAMHNEPLVLFQGDVLIIDSHIGRFWTYAIGGGTLNILSLLDKNEKAECFPPISKWVNSVEVRVLQEDCLGHCYDDISINPEDSTFRQR

SEQ ID NO: 9567 - protein, 123 aa, unidentified
  REGION 1..123: note = Description of Unknown:uncultivated organism sequence
RLWHDPEAKKGQGAWYADPVYKADIPALKDGTYVPRIAKAHTGRKAWKPVPESAMKKPPLEIYLGDLVQIGDFVGRFSGYNIANANWSFVDRLTKEALGCPTVVKLDNKLAPAIIRESIIMHQ

SEQ ID NO: 9568 - protein, 103 aa, unidentified
  REGION 1..103: note = Description of Unknown:uncultivated organism sequence
RLWHDPEAKKGQGAWYADPVYKADIPALKDGTYVPRMAKPPLEIYFDDLVQIGDFIERFSGYNINSANWSFTDRLTRLNLSCPTVGQLNNDLSPVVIRESPIK

SEQ ID NO: 9569 - protein, 122 aa, unidentified
  REGION 1..122: note = Description of Unknown:uncultivated organism sequence
RLWHDPEAKKGQGAWYADPVYKADIPALKDGTYVPRIAKQKYGRKVWKAVPNSALTQKPLEIYLGDLIKVGDKLGRYNGYNIATANWSFVDALTKKEIAFPSVGMLSNELQPIIIRESILDN

SEQ ID NO: 9570 - protein, 143 aa, unidentified
  REGION 1..143: note = Description of Unknown:uncultivated organism sequence
RLWLDPTARPNGKVKGKWYAEPVYYADIPAIKAGAYVPRACTIHVARVNWKPVPEAAMQIEPIMLYAGDVVEINNQLVRYSGFDINGATLYYQSLLNGATTTAIPSLGTWGKDTQVRVLQEDCLGHCYDGIAINPEDSTFQQR

SEQ ID NO: 9571 - protein, 142 aa, unidentified
  REGION 1..142: note = Description of Unknown:uncultivated organism sequence
DAVFDASVGKRGKWSFDPVYCIDIPHREDEIRTIRAFSKERAIDLWDSIKVPEDAQRMRIRRGDVLVCDGKAARFYCFDISVNAIRLYSQRGGKQLQTTGPLSSEAFPPPSKWGDDIRVMQEDCLGLCWLSFLSNRAIAQMD

SEQ ID NO: 9572 - protein, 143 aa, unidentified
  REGION 1..143: note = Description of Unknown:uncultivated organism sequence
RLWLDPTARPNGKVKGKWYAEPVYYADIPAIKAGTYVPRACTIHVARVNWEPVPEAAMELEPVVLYAGDVVEINNQLVRYSGFNINGATLYYQSLLNGATTTAIPSLGTWGKDTQVRVLQEDCLGHCYDGILINPEDSTFQKR

SEQ ID NO: 9573 - protein, 143 aa, unidentified
  REGION 1..143: note = Description of Unknown:uncultivated organism sequence
RLWLDPTARPNGKVKGKWYVEPVYYADIPAIRRGAYVPKACTIHVARTSWEPVPETALASRPITLYSGDVLRVDDHIGRYSSTDINGCRLVMLNLDSGNRVNDWPSIGSWGTTTQVQVLQEDCLGRCYGNVILHSDGSTFETR

SEQ ID NO: 9574 - protein, 143 aa, unidentified
  REGION 1..143: note = Description of Unknown:uncultivated organism sequence
RLWLDPTARPNGKVKGKWYAEPVYYADIPAIKAGTYVPRACTIHVARVNWEPVPEAAMEIEPVVLYAGDVVEINNQLVRYSGFNIRGATLYYQSLLNGATTTAIPSLGSWGKDTQVRVLQEDCLGHCYDGIAINPEDSTFQQR

SEQ ID NO: 9575 - protein, 143 aa, unidentified
  REGION 1..143: note = Description of Unknown:uncultivated organism sequence
RLWLDPDAPATGQTRGKWYAEPVYYADIPSIKHGDYVPRAIEQDVARINWQPIPESAKSSGPITVYPGDVVLVDNRAARFSKIGITKCQLTMLNLLSKERVTDWPSIGSWRQDTEVRVLGEDCLGHCYKHIAITRDSSTYRVE

SEQ ID NO: 9576 - protein, 121 aa, unidentified
  REGION 1..121: note = Description of Unknown:uncultivated organism sequence
RLWHDPKARKGRGAWYADPVYKAEISALKGGTYVPKIAKAHTGRKAWKPVPESAMVKPPLEIYLDDLVQIGDFVGRFSGFDIDNANWSFSDRLTRKKFRSPTVNKLSNDLSPLVIREPPIR

SEQ ID NO: 9577 - protein, 145 aa, unidentified
  REGION 1..145: note = Description of Unknown:uncultivated organism sequence
RLWLDPTARPNGKVKGKWYAEPVYYADIPAIKAGTYVPRACTIHVARVNWEPVPESAMASEPVVVFFGDVLVVDDKIGRYWSMGITNCAMEIRSLLNGSNLASGFPGTLNGWGKDTQVRVLQEDCLGHCYDGISINPEDSTFQQR

SEQ ID NO: 9578 - protein, 143 aa, unidentified
  REGION 1..143: note = Description of Unknown:uncultivated organism sequence
RLWLDPTARPNGKVKGKWYAEPVYYADIPAIKAGTYVPRACAIHIARVNWEPVPEAAMGANPVIVFFGDVLSVDDHVGRFGGFDIFGGRLALLNLLTKQKVSDWPSLGSWGKDTQVRVLQEDCLGHCYDSIAINPEGSTFQQR

SEQ ID NO: 9579 - protein, 141 aa, unidentified
  REGION 1..141: note = Description of Unknown:uncultivated organism sequence
RLWWDPTFKVRKGKEPGCYIPEPVFLSDLPKAFDCDYIPLIAPPQKDKKPREKWDSLSEELRNQKPVVLFRNDAIVIGSTVRRFAGFDIDGCSWTLLDPLGKMSQKEATKGLRISSIGPKTRFSVIHEDPLGKCFAPFLED

SEQ ID NO: 9580 - protein, 121 aa, unidentified
  REGION 1..121: note = Description of Unknown:uncultivated organism sequence
RLWHDPEAKKGQGCWYADPVYKADIPALKDGTYMPKIAKARTGRKAWKPVPECAMRHAPLEIYLGDLVKIGDFIGRFSGYNIANANWSFTDRLTRQKLSCPTVGKLNNALIPVIIRESSIR

SEQ ID NO: 9581 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPESAMKKPPLEIYLGDLVQIGDFVGRFSGFDINGANWSFSDRLTKKKLRSPTVNKLGNDPLPLIIRESPVR

SEQ ID NO: 9582 - protein, 121 aa, unidentified
  REGION 1..121: note = Description of Unknown:uncultivated organism sequence
RLWHDPKAKKGQGAWYADPVYKADIPALKDGTYVPRIAKAHTGRKAWKPVPESAMKKPPLEIYLGDLVQIGDFVGRFSGYNIDNANWSFVDRLTRIKTSCPTVGKLSNDMSPFVVRESPIK

SEQ ID NO: 9583 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPKSAMKKPPLEIYLGDLVQIGDFVGRFSGYNIDNANWSFVDRLTRIKISCPTVGKLSNDMSPFVVRESPIK

SEQ ID NO: 9584 - protein, 135 aa, unidentified
  REGION 1..135: note = Description of Unknown:uncultivated organism sequence
RLWLDPTARKGKGKWYAEPVYYADIPAIKNGTYIPRAAKAHVARVAWEPVPENALASAPVVLFSDNVIKVGSAIARYSRFDIGNAALVLENLRTGEECKKFPTLGRWNNELVPIIINEDCLGHCYKELAPNILEG

SEQ ID NO: 9585 - protein, 121 aa, unidentified
  REGION 1..121: note = Description of Unknown:uncultivated organism sequence
RLWHDPKAKKGQGAWYADPVYKADIPALKDGTYVPRIAKAHTGRKAWKPVPESAMKKPPLEIYLGDLVQIGDFVGRFSGFDIDNANWSFSDRLTRKKLRSPTVNKLSNDLSPLVIRESPIR

SEQ ID NO: 9586 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPESAMKKPPLEIYLGDLVQIGDFVGRFSGYNIHNANWSFVDRLTRIKISCPTVGKLSNDMSPFVVRESPIK

SEQ ID NO: 9587 - protein, 145 aa, unidentified
  REGION 1..145: note = Description of Unknown:uncultivated organism sequence
RLWLDPTARPNGKVKGKWYAEPVYYADIPAIKAGTYVPRACTIHVARVNWKPVPEAAAQQKPVVLYPGDVLQVGSHVGRYRSFDISNCGLSVNSLVNKDVIAPGFPKTLGGWGKDTQVRVLQEDCLGNCYDHIAINPDDSTFRQR

SEQ ID NO: 9588 - protein, 143 aa, unidentified
  REGION 1..143: note = Description of Unknown:uncultivated organism sequence
DAVFDASVGKRGKWAFDPVYCIDIPHRDAERRTMRAFSKEKAIDLWDTVEVPEDALRMTIRRGDVLVCDGKAARFHGFNISDNTIKLFPQRVGKQLQETGPLSDEAFPSPSKWGDGIRVMQEDCLGLCWLSFLAQRAAVTQTE

SEQ ID NO: 9589 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPKSAMAKPPLEIYFDDLVQIGDFIGRFSGYNINSANWSFTDRLTRLNLSCPIVGQLNNDLSPVVIRESPIK

SEQ ID NO: 9590 - protein, 143 aa, unidentified
  REGION 1..143: note = Description of Unknown:uncultivated organism sequence
RLWLDPTARPNGKVKGKWYAEPVYYVDIPAIKAGAYVPRACTIHVARVNWKPVPEEAMQIEPIMLYAGDVVEINNRLVRYSGFDINGATLYYQSLLNGATTTAIPSLGTWGKDTQVRVLQEDCLGHCYDGIAINPEDSTFQQR

SEQ ID NO: 9591 - protein, 120 aa, unidentified
  REGION 1..120: note = Description of Unknown:uncultivated organism sequence
RLWHDPEAKKGQGAWYADPVYKADIPALKDGTYVPRIAKAATGRKAWKAIPQNVLNSAPLEIYLGDLVQIGNQKGRFRGINIDTVSWSFVDALSKLPVKMPTIGRLNNETIPTVIRELLI

SEQ ID NO: 9592 - protein, 143 aa, unidentified
  REGION 1..143: note = Description of Unknown:uncultivated organism sequence
EAVFDASAGKRGRWSFDPVYCIDIPHRDAERRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAADVQME

SEQ ID NO: 9593 - protein, 122 aa, unidentified
  REGION 1..122: note = Description of Unknown:uncultivated organism sequence
RLWHDPEAKKGQGAWYADPVYKADIPALKDGTYVPRIAKQNYGRKVWKAIPDSLLIQKPLEIYLGDLIRVGDKLGRYNGYNIAKANWSFVDALTKKEIAFPSVGMLSNELRPIVIRKSILDN

SEQ ID NO: 9594 - protein, 143 aa, unidentified
  REGION 1..143: note = Description of Unknown:uncultivated organism sequence
EAVFDASAGKRGRWSFDPVYCIDIPHREAVRRTMRAFSKEKAIDLWDTVAVPEAAPRMTIRRGDVLVCDGKAARFHCFDISVNAIRLFSQRGGKQLQATGPLSAEAFPPPSKWGEGVRIMQEDCLGLCWLSFLAQRAAGVQME

SEQ ID NO: 9595 - protein, 122 aa, unidentified
  REGION 1..122: note = Description of Unknown:uncultivated organism sequence
RLWHDPEAKKGQGAWYADPVYKADIPALKDGTYVPRIAKAHTGRKAWKPVPESAMKKPPLEIYLGDLVQIGDFMGRFSGYNIANANWSFVDRLTKEALGCPTVVKLDNKLAPAIIRESIIMH

SEQ ID NO: 9596 - protein, 120 aa, unidentified
  REGION 1..120: note = Description of Unknown:uncultivated organism sequence
RLWHDPEAKKGQGAWYADPVYKADIPSLKDGTYVPKIAKAATGRKAWKAIPQNVLNSAPLEIYLGDLVQIGNQKGRFRGINIATVSWSFVDTLSKLPVKMPTIGRLNNETIPTVIRELLI

SEQ ID NO: 9597 - protein, 120 aa, unidentified
  REGION 1..120: note = Description of Unknown:uncultivated organism sequence
RLWHDPEAKKGKGAWYADPVYKADIPSLKDGTYVPKIAKAATGRKAWKAIPQNVLNSAPLEIYLGDLVQIGNQKGRFRGINIDTVSWSFVDTLSKLPVKMPTIGRLNNETIPTVIRELLI

SEQ ID NO: 9598 - protein, 121 aa, unidentified
  REGION 1..121: note = Description of Unknown:uncultivated organism sequence
RLWHDPEAKKGQGAWYADPVYKADIPALKDGTYVPRIAKAHTGRKAWKPVPESAMKKQPLEMYLGDLVQIGDFVGRFSGYNIDNANWSFVDRLTRIKISCPTVGKLSNDMSPFVVRESPIK

SEQ ID NO: 9599 - protein, 140 aa, unidentified
  REGION 1..140: note = Description of Unknown:uncultivated organism sequence
RLWHDPDFGKDGRWYVEPVYYNDIPALGNGVYQPKYILSKHPRMEWLPVPEAALSGTPLTLFPGDIIVAGNHIARFKKLDIACQGLGMLNILNEQLAVKNFPTINRWKNDMNIFILQEDCLGKCFNSLDIDSGSSTFTLR

SEQ ID NO: 9600 - protein, 144 aa, unidentified
  REGION 1..144: note = Description of Unknown:uncultivated organism sequence
RLWLDPNARPNGKVKGKWYAEPVYYADIPAIKAGTYVPRACTIHVARNAWEPVPESAMQREPVVLFAGDVVEVDGHIGRYSGFNIFGGRITILNLLTKAEVGDWPSLGSWGRDTQVRVLQEDCLGHCYDDIVINPDNSTFRQRE

SEQ ID NO: 9601 - protein, 146 aa, unidentified
  REGION 1..146: note = Description of Unknown:uncultivated organism sequence
RFWLDAEARPKGKVKGKWLIEPVYYADIPLIQCGRYIPKYIPAAHLARDQWVEIPESVLATDPVTVFFGDVLYVDGHIGRYSGFNINGLKLTMHSVISGESIAFPPVSSTWSKDSEVRIIEEDVLGRCWTPNIAKLVRLQEAASSS

SEQ ID NO: 9602 - protein, 140 aa, unidentified
  REGION 1..140: note = Description of Unknown:uncultivated organism sequence
RLWHDPHAGKTGRWYIEPVYCADIPNLDGKTYHPRYQKQKVARSGWPLVPAEALKNKPLLLFRGDVLIVGNHIARYWKFDIGGGKVTMLSIVDINSEAKGFPSISKWKNDMPVRILSEDCLASCYKHMTIDSENSTFEER

SEQ ID NO: 9603 - protein, 135 aa, unidentified
  REGION 1..135: note = Description of Unknown:uncultivated organism sequence
RLWIDPTAKKGKGKWYAEPVYYADIPAIKNGTYVPRAGKATVARNAWEAIPEAAHRTKPLVLFCGDVISMDGHTARYWSFSINTLTLKTKDLITGDDYKDFPTLGKWSKDSYPKIIQEDCLGHCYKGLVPKSSEG

SEQ ID NO: 9604 - protein, 138 aa, unidentified
  REGION 1..138: note = Description of Unknown:uncultivated organism sequence
RLWHDSKNGKWYPEPVYYYDLPRLDSDAYVSRYITRNRSRDKWHEVPSEAMNERPLVVHRNDVLVVDGHVGRYITVDIAGGTIDVRSLLSKAKDGNLALATGFPSLSRWKDAWVVNEDCLGHCYDGFIVNSDCLAVIG

SEQ ID NO: 9605 - protein, 135 aa, unidentified
  REGION 1..135: note = Description of Unknown:uncultivated organism sequence
RLWLDPTAKKGKGKWYAEPVYYADIPAIKNGTYIPKAGKRGVARIVWEPISQVARNTKPLVLFRGDVISMGGHTVRYWSFSINTLTLRTRDLITGAEYKGFPTINQWSRDSYPKKIQEDCLGHCYKGLVPSSLED

SEQ ID NO: 9606 - protein, 140 aa, unidentified
  REGION 1..140: note = Description of Unknown:uncultivated organism sequence
RLWHDPHAGKTGRWYIEPVYCADIPNLDGKTYHPRYQKQKVARSGWPLVPAEALKNKPLLLFRGDVLIVGNHIARYWKFDIGGGKATMLSIVDINSEAKGFPSISKWKNDMPVRILSEDCLASCYKHMTIDSENSTFEER

SEQ ID NO: 9607 - protein, 193 aa, unidentified
  REGION 1..193: note = Description of Unknown:uncultivated organism sequence
RLWLDKTAKGPKGSVGKWYAEPVYYADIPAIKNGTYVPRACKIHVARVNWEPVPSCALESEPIVLHRGDVLIVDEHIGRFWTIDINSCGLEIRSISTGEPIGPSFPSTPASWNASTTISVLQEDCLGHCYNQLPLNREDSTFFLLSRRCPVHNGRGTSLESQRHLRTRINSRTMFWPCVHQHLSRFVLFFRQR

SEQ ID NO: 9608 - protein, 126 aa, unidentified
  REGION 1..126: note = Description of Unknown:uncultivated organism sequence
RLWFDPEVKKKGKVVGGWYANPLYKADLPDLRKGTYVPKAVKPRHGRSAWLEIPERMLEQKPVEIYRGDLVEIDGKNGCFVGYNIANGSWTFVDPLTREEIDMPSLASLSSQTNLKVVRRGLLPMD

SEQ ID NO: 9609 - protein, 125 aa, unidentified
  REGION 1..125: note = Description of Unknown:uncultivated organism sequence
RLWRDFEVKKKGRVIGAWYADPVYKADVPSLQDGTYVPRIAKRGYGRSVWPRIPERLLSQRPVELYRGDLVEIDGKIGRFVGYNIANGSWTFADPLDGNEVEMPSLPSLNNETSLKVIRRGLVTS

SEQ ID NO: 9610 - protein, 135 aa, unidentified
  REGION 1..135: note = Description of Unknown:uncultivated organism sequence
RLWIDPTARKGKGKWYAEPVYYADIPAIKNGTYVPRAGKISVARNAWEPIPEAARRTKPLVLFRGDVISMDGHTARYWSFGISTLTLKTKDLITGTEYKGFPTLSKWSKDSYPKKIQEDCLGHCYKGLVPKSLEG

SEQ ID NO: 9611 - protein, 135 aa, unidentified
  REGION 1..135: note = Description of Unknown:uncultivated organism sequence
RLWLDPTARKGKGKWYAEPVYYADIPAIKNGTYKPRAAKAHVARVAWEPVPENALASAPVVLFSDSVIKVGSAIARYSRFDIGNAALVLENLKTGEECKKFPTLGRWNNELVPIIINEDCLGHCYKELVPNILEG

SEQ ID NO: 9612 - protein, 147 aa, unidentified
  REGION 1..147: note = Description of Unknown:uncultivated organism sequence
DVFRAEEKGKKKYYFIPVYVADTVKEELPNRAVLAHKPYEAWKIMKEENFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 9613 - protein, 161 aa, unidentified
  REGION 1..161: note = Description of Unknown:uncultivated organism sequence
DVFFIPEGRELGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 9614 - protein, 161 aa, unidentified
  REGION 1..161: note = Description of Unknown:uncultivated organism sequence
DVFFIPEGREHGYYLVPVYTSDVVRGELPMRAVVAHKSYAEWKIMREEDFLFSLYPNDLIWIENKKGIKVNLPNKLAKNSSLTASRVQKEGFFYYKGMNIANAQFDVVVHDGTYRQESLGVKTLTKMEKWTIDVLGGEVNQVSREQRQGFNDMKRDPHAIK

SEQ ID NO: 9615 - protein, 146 aa, unidentified
  REGION 1..146: note = Description of Unknown:uncultivated organism sequence
DIFGVNEKGKNAYYFVPVYVSDTVKKELPCRGVVKRKSYENWKIMDDKDFLFSLYHNDMIHVVSKKPLSFTAAKGSSLLPKMETKDTYVYYKGADIKGVSITVINHDNSYGIKGMGIKTLLQLEKCEVDVLGNISFVKQEKRQGFR

SEQ ID NO: 9616 - protein, 153 aa, unidentified
  REGION 1..153: note = Description of Unknown:uncultivated organism sequence
DIFKAKGKNGKSSYYAVPIYVADTVKVELPNRAVVTKKTYAEWPEMKTEDFAFSLYPNDVVYIGGKEIKMNVMPGCTLATENHVKDDFFYYKGLDIATGAMIVINHDGTYKQRGVGIKQLPLIEKYEVSVLGDLVKAIYRPREIFKHKAQRSK

SEQ ID NO: 9617 - protein, 153 aa, unidentified
  REGION 1..153: note = Description of Unknown:uncultivated organism sequence
DIFRVKEKNNKHSYYAVPIYVADTVKDKLPNKAIVAKKNYDEWLEMKKEDFVFSLYPNSAVYIGGKDIKMNVMSGCTLELEKTMRDTILYYKGLDISPGALKIINHDGTYQQRGLGIKSLPFIEKYEVSVLGDLVKATYRPRETFNHKAQRSK

SEQ ID NO: 9618 - protein, 147 aa, unidentified
  REGION 1..147: note = Description of Unknown:uncultivated organism sequence
DVFRAEEKGKKKYYFIPVYVADTVKEELPNRAVLAHKPYEAWKIMKEEDFIFSLYPNDLILVDAGKEIPFKAALKGSTLDPEKKASRFLMYYKGADIATGSISGVNHDETYKARGVGIQSLREIKKCCIDVLGNISFASKEKRQTFR

SEQ ID NO: 9619 - protein, 147 aa, unidentified
  REGION 1..147: note = Description of Unknown:uncultivated organism sequence
DVFRVEEKGKKKYYFIPVYVADTVKEELPNRAVLAHKLYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 9620 - protein, 146 aa, unidentified
  REGION 1..146: note = Description of Unknown:uncultivated organism sequence
DVFQAEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 9621 - protein, 146 aa, unidentified
  REGION 1..146: note = Description of Unknown:uncultivated organism sequence
DVFCVNKKGKKAYYFVPIYVADTVKKELPGKAVVSGKPYSAWKPMDDKDFIFSLYKNNLIYIEFNKPKSFVAEEGCTLSQTVDVKKAFLYYIKADRFAGTITVVNHDNTYKTRTGIKNTLLRFKKCVVDPLGRISFVEKEKRQRFQ

SEQ ID NO: 9622 - protein, 146 aa, unidentified
  REGION 1..146: note = Description of Unknown:uncultivated organism sequence
DIFGVNEKGKNAYYFVPVYVSDTVKKELPCRAVVAHKPYEEWKVMDDKDFLFSLYPNDMIHVVAKREIPFTAAKGSDLEPKIQIKDTFVYYVGANIATGNIAVISHDHSYEQGSMGIKTLSQLEKCEIDVLGNVSFVKQEKRQGFR

SEQ ID NO: 9623 - protein, 152 aa, unidentified
  REGION 1..152: note = Description of Unknown:uncultivated organism sequence
DIFKVQEKNGKSYYYAVPIYVADTVKSELPKKAVYRRPYDEWPEMKEADFAFSLYPNDVVYIGGKEIKMNVMPGCTLESEKSMRDEVLYFKGLDIATGTIRVVNHDGTYKQKSLGIKQLSIIEKYEVSVLGDLVKAMYSPRETFKHKAQRAK

SEQ ID NO: 9624 - protein, 153 aa, unidentified
  REGION 1..153: note = Description of Unknown:uncultivated organism sequence
DVFKVKKSNGGHQYYLVPIYVSDTVKERLPNRAVMAHKEYDEWKIVDDKDFVFSLYSNDLLFIGGKEIKLNGTGGDTLHQGIMVQNVYLYYRGLNIAAGTISVEDHDSKYIQESLGVGRVPVLEKYEVSVLGDLIKAPYRPRETFKHKAQRSK

SEQ ID NO: 9625 - protein, 147 aa, unidentified
  REGION 1..147: note = Description of Unknown:uncultivated organism sequence
DVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 9626 - protein, 150 aa, unidentified
  REGION 1..150: note = Description of Unknown:uncultivated organism sequence
DVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGNVTFVGRENRQPFQLSKK

SEQ ID NO: 9627 - protein, 147 aa, unidentified
  REGION 1..147: note = Description of Unknown:uncultivated organism sequence
DVFRVEEKGKKKYYFIPVYVADTVKEELPNRAVLAHKPYEAWKIMKEEDFIFSLYPNDLIFVDAGKEIPFKAALKGSTLDPEKKVSRFLMYYKGADIATGSISGVNHDETYKARGVGIQSLREIKKCCIDVLGNISFASKEKRQTFR

SEQ ID NO: 9628 - protein, 158 aa, unidentified
  REGION 1..158: note = Description of Unknown:uncultivated organism sequence
DVFKVKKSNGGHQYYLVPIYVADTVKERLPNRAVMAHKEYDEWKIVDDKDFVFSLYPNDLLFIGGKEIKLNGTGGDTLHQGIMVQNVYLYYRGLNIAVGTISVEDHDSKYIQESLGVGRVPVLEKYEVSVLGDLIKAQYRPRETFKHKAQRTKDQVNV

SEQ ID NO: 9629 - protein, 146 aa, unidentified
  REGION 1..146: note = Description of Unknown:uncultivated organism sequence
DVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKEKRKTFR

SEQ ID NO: 9630 - protein, 146 aa, unidentified
  REGION 1..146: note = Description of Unknown:uncultivated organism sequence
DIFGVNEKGKTAYYFVPVYVSDTVKKELPCRAVVAHKPYEEWKVMDDKDFLFFLYPNDMIHVVAKRDLSFTAAEGADLAPTMETKDTCVYYKAADISAGNIKVITHDNSYEKRGFGIKTLLQLEKCEVDVLGNISVVKKEKRQGFC

SEQ ID NO: 9631 - protein, 146 aa, unidentified
  REGION 1..146: note = Description of Unknown:uncultivated organism sequence
DVFGVEERGKNAYYFVPIYVADTVRETLPNKAVVPNKSYNDWKFMRDEDFLFSLYPNDLIYIESLSPVSFHTVKGCTLVPKIERKEMLLYYRKAGISTASITVLNHDNTYVKESLGIKTIGKLQKCTVDILGNVHYVQKEKRLGFK

SEQ ID NO: 9632 - protein, 146 aa, unidentified
  REGION 1..146: note = Description of Unknown:uncultivated organism sequence
DVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIAGGTINGVNHDSTYGIRIGLQRLKGIRKCRIDVLGNISLVGKEKRKTFR

SEQ ID NO: 9633 - protein, 146 aa, unidentified
  REGION 1..146: note = Description of Unknown:uncultivated organism sequence
DIFGVNEKGKMAYYFVPVYVSDTVKRELPCRAVVQDKSYENWKMMDDKDFLFSLYPNDMIHVVAKRDLSFTAAEGSSLAPKMKTKDAYVYYKGADINGGTITVINHDNSYGIKSMGIKTLLQMEKCEVDILGNISVVKQEKRQGFR

SEQ ID NO: 9634 - protein, 153 aa, unidentified
  REGION 1..153: note = Description of Unknown:uncultivated organism sequence
DVFKVKKGNGGHQYYLVPIYVADTVKEKLPNRAVVGSTSYDGWKILHDDSFVFSLYPNELVHISGKKIKLKGTGGNTKGQEINIEDAYLYYKALNISNGMITVVTHDNTYIQESLGIGRVPTLEKYEVSVLGDLVKATYRPRETFKHKAQRFK

SEQ ID NO: 9635 - protein, 153 aa, unidentified
  REGION 1..153: note = Description of Unknown:uncultivated organism sequence
DIFKVKKSNGGHQYYSVPIYVADTVKEALPNRAVVAYKEYDEWKIVDDKDFVFSLYPNDLLFIGGKEIKLNGTGGDTLHQGIMVQDVFLYYRGLNIAVGSIGVENSDGRYAQDSLGIKQLPIIEKYEVSVLGDLVKAMYRTRETFKHKAQRAK

SEQ ID NO: 9636 - protein, 147 aa, unidentified
  REGION 1..147: note = Description of Unknown:uncultivated organism sequence
DVFRVEEKGKKKYYFIPVYVADTVKEELPNRAVLAHKPYEAWKIMKEEDFIFSLYPNDLIFVDAGKGIPFKAALKGSTLDPEKKASRFLMYYKGADIATGSISGVNHDETYKARGIGIQSLREIKKCCIDVLGNISFASKEKRQTFR

SEQ ID NO: 9637 - protein, 146 aa, unidentified
  REGION 1..146: note = Description of Unknown:uncultivated organism sequence
DVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTINGVNHDNTYGIRIGLQQLKGIRKCRIDVLGNISFASKEKRQTFR

SEQ ID NO: 9638 - protein, 152 aa, unidentified
  REGION 1..152: note = Description of Unknown:uncultivated organism sequence
DIFKAKEKNGKYSYYAVPIYVADTVKEELPNKAVCNKEYNRWPKMKEEDFAFSLYPNDVVYIGGKEIKMNAAPGCTLETTRSIQDVNLYFRGMDISTGAIRVVNHDGTYKQKSLGIKQLPLIEKYEVSVLGDLVKAIYKPRETFKHKVRRSK

SEQ ID NO: 9639 - protein, 146 aa, unidentified
  REGION 1..146: note = Description of Unknown:uncultivated organism sequence
DVFGVEERGKMAYRFIPIYVSDTVKRILPNKAVTRDRGYKDWDIMDDKDFLFSLYPNDLIYVESKRDISLKAAKGSTLAKERKQKEALVYYRGADIATASIGVVNDDNTYSMRGLGIKTLQSIRKCIVDVLGNVAFVTKEKRQGFR

SEQ ID NO: 9640 - protein, 152 aa, unidentified
  REGION 1..152: note = Description of Unknown:uncultivated organism sequence
DIFKVKEKNDKSSYYAVPIYVADTVKSELPKKAVCQKPYDEWPEMKEADFAFSLYPNDVIYIGGKELKMNAVLGCTLETTRSMQDVNLYFKGMDISTGAIQVVNHDGTYKQRSLGIKQLPLIEKCEVSVLGDLVKAQYRPRETFKHKAQRSK

SEQ ID NO: 9641 - protein, 153 aa, unidentified
  REGION 1..153: note = Description of Unknown:uncultivated organism sequence
DIFRVKEKNNKHSYYAVPIYVADTVKDKLPNKAIVAKKNYDEWLEMKKEDFVFSLYPNSAVYIGGKDIKMNVISGCTLELEKTMRDTILYYKGLDISPGALKIINHDGTYQQRGLGIKSLPFIEKYEVSVLGDLVKATYRPRETFNHKAQRSK

SEQ ID NO: 9642 - protein, 146 aa, unidentified
  REGION 1..146: note = Description of Unknown:uncultivated organism sequence
DVFGVEERGKNAYYFVPIYVADTVKETLPNKAVVPNKSYNDWKVMRDEDFLFSLYPNDLIYIESPTPISFHTVKGCPLVPKIERKEMFLYYRKAGISTASITVLNHDNTYVKESLGIKTIAKLQKCTVDVLGNIHYVQKEKRLGFK

SEQ ID NO: 9643 - protein, 146 aa, unidentified
  REGION 1..146: note = Description of Unknown:uncultivated organism sequence
DVFGVEEKGKNAYYFVPIYVADTVKETLPNRAVTRGEPYNNWKIMKDEDFLFSLYPNDLIYIESLSPVSFHTVKGCTLVSKIERKEMLLYYRKAGISTASITVLNHDNTYVKESLGIKTIGKLQKCTVDILGNVHYVQKEKRVGFK

SEQ ID NO: 9644 - protein, 146 aa, unidentified
  REGION 1..146: note = Description of Unknown:uncultivated organism sequence
DVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLRRLKGIRKCRIDVLGNISLVGKEKRKTFR

SEQ ID NO: 9645 - protein, 150 aa, unidentified
  REGION 1..150: note = Description of Unknown:uncultivated organism sequence
DVFYVSEKGKKAYYFVPIYVADTVKKELPHKAVVAYKPCEEWKNVDDDDFIFSLYPNDLVYVRHKKSILLKASKRSTLSPQIKIKEGLFYYKGANISVGSISIINNDDTYGQHSLGIKTLECMKKANVDILGHVTFVGRENRQSFQLSKK

SEQ ID NO: 9646 - protein, 169 aa, unidentified
  REGION 1..169: note = Description of Unknown:uncultivated organism sequence
DVFYRAEGKGKGYYLVPVYVADTVKDELPVKAVTRRKAYKDWDEMKSDEFLFSLYKDDLLLVRSAKDIELSFLGRKGESGNLLTTYKTREFLCYYQGTNRAACSITICNQDNTYAKESMGIKTLALLKKMQVDVLGQVSEAPAEKRQGFKQMKKDPHRRCGKNVSAPDD

SEQ ID NO: 9647 - protein, 169 aa, unidentified
  REGION 1..169: note = Description of Unknown:uncultivated organism sequence
DVFYRAEGKGKGYYLVPVYVADTVKDELPLKAVTQRKDYADWEIMRSKDFLFSLYKDDLLLVRSTKDIEMKFNEKKKEKSTLPAIFRTREVFAYYQGTDSSTASITVCNHDNTYGKRGMGVKTIALLKKMQVDVLGQISEAPAEKRQGFKQMKKDPHRRCGKNVSAPDD

SEQ ID NO: 9648 - protein, 157 aa, unidentified
  REGION 1..157: note = Description of Unknown:uncultivated organism sequence
DVYYVSEGKKKGYYLVPIYVADTLKPVLPNKAVKAHKVYDEWEEMNVEDFVFSLYPNDLVYIEHKSGFKLKVVSKKSTLQNETYGKTGVFYYCSMNISTGALNLENLDGTYQVESLGVKTLICLRKGEIDTLGNIRLLENEVRKGFSYMKKDRYRKV

SEQ ID NO: 9649 - protein, 157 aa, unidentified
  REGION 1..157: note = Description of Unknown:uncultivated organism sequence
DVYYIPDGKKHGYYLVPVYVSDVVRKTLPNKAIVADTPYAEWPEMREEDFLFSLYKNDLIHLRKKKPAKMKVIQKESTLQKEIAVSEGNAYYISTDSATASIKIINHDNTYYTKGLGVKTLLSLEKMQVDVLGNITPAPREPRQDFSAMKRDRFARK

SEQ ID NO: 9650 - protein, 103 aa, unidentified
  REGION 1..103: note = Description of Unknown:uncultivated organism sequence
DVFRSEEKGKKKYYFIPIYVADTVKEELPNRAALAHKPYEAWKIMKEEDFIFSLYPNDLIFVDAGKEIPFKAALKGSTLDPEKKASRFLMYYKGADIAGGTIN

SEQ ID NO: 9651 - protein, 142 aa, unidentified
  REGION 1..142: note = Description of Unknown:uncultivated organism sequence
DIFKTADGYYWVPIYVNDTVKPNLPNKAVLAAKPLDLWIEMQDDDFIFSLYSNDLVRFVHKTGTNFNCWDESKINLKESFMYYIKANINNAALEVVSHDRSYSKSSLGIKSLVAFEKWNVDILGNRSLVKKETRQYFPGQTK

SEQ ID NO: 9652 - protein, 144 aa, unidentified
  REGION 1..144: note = Description of Unknown:uncultivated organism sequence
DVFFVEGEGYYLVPIYVSDTVKKELPNKAIVAHKPYEEWKEMREENYVFSLYQNDLIGIKLKKEMKFSLVQKNSTLPKNINVKDGLFYYKGTNISGANISVINNDNTYTVESLGVKRIPVIEKYQVDVLGNVSKVGKEKRVRFQ

SEQ ID NO: 9653 - protein, 154 aa, unidentified
  REGION 1..154: note = Description of Unknown:uncultivated organism sequence
DVFKVENAPKKGDNGYYWVPVYVNDFVKHTLPNLARPSLKEMKDEDFIFSLYPNDCIYVKHKDNMEFTREDEVVEGDKVVKNISKTTCNDVYIYYVKAGISGGAITVKSHDSLYNLSSLGVKGLKEISKCSVDTLGNITKITTKQVREKFPNQK

SEQ ID NO: 9654 - protein, 154 aa, unidentified
  REGION 1..154: note = Description of Unknown:uncultivated organism sequence
DVFKVENAPKKGDNGYYWVPVYVNDFVKHTLPNLARPSLKEMKDEDFIFSLYPNDCIYVKHKDNMEFTREDEVVEGDKVVKNISKTTCKDVYIYYVKAGISGGAITVKSHDSLNNLSSLGVKGLKEISKCSVDTLGNITKITTKQVREKFPNQK

SEQ ID NO: 9655 - protein, 144 aa, unidentified
  REGION 1..144: note = Description of Unknown:uncultivated organism sequence
DVFYVDGEGYYLVPIYVADTVKKELPNKAIVAYKPYEQWKEMSDKNFLFSLYPNDLIHIVSKKDMKFSLVNKDATLAKNCVSKDAFVYFKGTDIATASIAAINHDNTYKLRGLGVKSLLSIEKCQVDVLGNITKAGREKRMGFR

SEQ ID NO: 9656 - protein, 140 aa, unidentified
  REGION 1..140: note = Description of Unknown:uncultivated organism sequence
DVFRTEDGYYLVPIYVADTVKNELPHKAIVQGGEWKVMNDEDFLFSLYRNDLIKIKSNSDVTFSLMNESSSLPKTESLREEFVYFKETSINTASIRVVTHDNCYIKKSLGVKNLQSLEKYQVDVLGNVSKVKKEKRMGFR

SEQ ID NO: 9657 - protein, 144 aa, unidentified
  REGION 1..144: note = Description of Unknown:uncultivated organism sequence
DVFYVEGEGYYLVPIYVSDTVKKVLPNKAVVGSKSYNDWKVMNDENFIFSLYPSDLIRVVSNTVKKFSLVNKNSTLKDTIDSKDIFLYFKKTKIANAAITVINHDNTYTIPSLGVKELLKLEKYQVDVLGNKSKCGKEKRMGFN

SEQ ID NO: 9658 - protein, 140 aa, unidentified
  REGION 1..140: note = Description of Unknown:uncultivated organism sequence
DVFRTEDGYYLVPIYVADTVKNELPNKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 9659 - protein, 139 aa, unidentified
  REGION 1..139: note = Description of Unknown:uncultivated organism sequence
DLYYVEGEGYYFIPIYISDLMKEELPKKACVPHKEYHDWKNMKDEDFLYSIYPNDLLYIKSSTPKKFAKKRGEKKDSFEAEEAFVYYREAGISGATITVETHDNNYTIQSLGVKTLSRIEKYHVDVLGNKYKAAVEERK

SEQ ID NO: 9660 - protein, 140 aa, unidentified
  REGION 1..140: note = Description of Unknown:uncultivated organism sequence
DVFRTEDGYYLVPIYVADTVKNELPHKAIVQSGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 9661 - protein, 139 aa, unidentified
  REGION 1..139: note = Description of Unknown:uncultivated organism sequence
DLYYVEGEGYYFIPIYISDLIKKELPKKACVPHKEYHDWKNMKDEDFLYSIYPNDLLYIKSSTPKKFTKKKGEKKDSFEAEEAFVYYREAKISGATITVVTHDNNYTIQSLGVKTLSRIEKYHVDVLGNKYKAAVEERK

SEQ ID NO: 9662 - protein, 145 aa, unidentified
  REGION 1..145: note = Description of Unknown:uncultivated organism sequence
DVFRTEDGYYLVPIYVADTVKNELPNKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFRWWDIG

SEQ ID NO: 9663 - protein, 144 aa, unidentified
  REGION 1..144: note = Description of Unknown:uncultivated organism sequence
DVFYVEGEGYYLVPIYVADTVKKQLPNKAIIPRKSYDNWKEMNDDDFLFSLYPNDLIHIVSKKDMKYSLVNKDATLAKNFLTKDICVYFRKSSISTASISVINHDNTYEIPSLGVKGLLMLEKCQVDVLGNVTKSGREKRMRFR

SEQ ID NO: 9664 - protein, 144 aa, unidentified
  REGION 1..144: note = Description of Unknown:uncultivated organism sequence
DVFFVEGEGYYLVPIYVADTVKKELPNKAIIANKPYEEWKEMREENFVFSLYPNDLIKISSRKDMKFNLVNKESTLAPNCQSKEALVYYKGSDISTAAVTAINHDNTYKLRGLGVKTLLKIEKYQVDVLGNVFKVGKEKRVRFK

SEQ ID NO: 9665 - protein, 144 aa, unidentified
  REGION 1..144: note = Description of Unknown:uncultivated organism sequence
DVFFVENEGYYLVPVYVSDTVALDLPNRAIVGGKPYSKWKEMDNDNFVFSLYPNDLIKVKSKRDMKFNLVNPDSTLAKNYTARESMLYYKGTDISTAAITAINHDNTYKLRGLGVKSLLSIEKYSVDVLGNKTKVNKEKRMGFV

SEQ ID NO: 9666 - protein, 107 aa, unidentified
  REGION 1..107: note = Description of Unknown:uncultivated organism sequence
DVFFVEEEGYYLVPVYVADTVKPELPNRAIVGGKPYDKWKEMDNDDFVFSLYPNDLIKVKSKRDMKFNLVSPDSTLAKNYAARESMLYYIGTDISTAAITAINHDNT

SEQ ID NO: 9667 - protein, 144 aa, unidentified
  REGION 1..144: note = Description of Unknown:uncultivated organism sequence
DVFFVEGEGYYMVPIYVSDTVKPELPNKAIIANKPYTEWKEMKEQDFLFSLYPNDLIRIKFNKEKQFSLVQKDSTLAKNLLLSEGYFYYKKASISSASITIINNDNTYTVASLGVKRIPLIEKYQVDVLGNIQKVGKEKRMRFR

SEQ ID NO: 9668 - protein, 144 aa, unidentified
  REGION 1..144: note = Description of Unknown:uncultivated organism sequence
DVFFVEGEGYYLVPIYVADTVKKELPQKAIIANKTYENWKEMKEENFVFSLYPNDLIRIKSKKEMKFNLVNKESTLAPHYQSKDAYVYYKGSDISTAAITAITHDNTYKLRGLGVKTLLAIEKYQVDVLGNIIKIGREKRMRFR

SEQ ID NO: 9669 - protein, 130 aa, unidentified
  REGION 1..130: note = Description of Unknown:uncultivated organism sequence
DVFKKGDGYYWVPIYVADTVKETLPNKACVHSKPYELWKEMDDNDFIFSLYPNDLIRFIPNNGEEAFMYYIKAGISTASITVESHDRSQSIPSLGVKTLKILEKWNVDVLGNRTLVKNEKRQYYPGQTTR

SEQ ID NO: 9670 - protein, 129 aa, unidentified
  REGION 1..129: note = Description of Unknown:uncultivated organism sequence
DVFKTEEGYFWVPIYVADTVKKTLPNKAALQSKPYELWPEMSDDDFIFSLYPNDLIRFQREKDKDEFMYYKKAGISTASITVESHDRSYSIPSLGVKTLLLLEKWEVDVLGNRYRVKKERRQYFPGQVR

SEQ ID NO: 9671 - protein, 143 aa, unidentified
  REGION 1..143: note = Description of Unknown:uncultivated organism sequence
DVFYVAGEGYYLVPIYVSDTVKKELPNRACVANKPYSEWKVMDDKNFLFSLYNNDLVKITFKREKKFSLVNKDSTLDKEHRTKSELLYYKGTNIHTASITVITHDNTYIFEGMGVKTLISIEKYEVDVLGRVRKVNKEKRMGF

SEQ ID NO: 9672 - protein, 160 aa, unidentified
  REGION 1..160: note = Description of Unknown:uncultivated organism sequence
AIYKDKDGKRQEHIVTFWHAVERKKYGMPVVITNPKEIWDLIIEKSLDLPESFLNCLPNSDWNYEISMQQNEMFVMGMSEDEFQDAIRNNDYKTLNKYLYRVQSVSESDYWLRLHIETMNDKTPEGNIIKKYYRIKSINTFFNFNPHKVKITLLGEIQSS

SEQ ID NO: 9673 - protein, 161 aa, unidentified
  REGION 1..161: note = Description of Unknown:uncultivated organism sequence
AIYKDKEGKYQKHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 9674 - protein, 166 aa, unidentified
  REGION 1..166: note = Description of Unknown:uncultivated organism sequence
AIYRDAKGQYQESVVSFWQAVERKRYGIPVVIEQPHEVWDKLINSDNIPQDFLETLPHDDWQFVVSLQQNEMFILGMDDADFEAAMEQKDYRTLNKYLYRVQKISSKEYCFRYHTETSVDDKYDGVINKSISMELQKLKRLTSISAFFSQHPHKVRVNLLGEVSAL

SEQ ID NO: 9675 - protein, 161 aa, unidentified
  REGION 1..161: note = Description of Unknown:uncultivated organism sequence
AIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKDYYFRYQYETQLDDKEAALSMKKFYRVTSLSSLQSLNPKKVSINLLGDISLHNII

SEQ ID NO: 9676 - protein, 161 aa, unidentified
  REGION 1..161: note = Description of Unknown:uncultivated organism sequence
AIYKDKEGKYQEHTVTFWHAVERKKYGIPIIIEHPDEVWQKVLDLDAPQSFIDQLPSPDWTYVMSMQQNEMFILGMGDDEFNDAMSAKDYRTLAQHLYRVQKVCSKNYYFRYQYETQLDDKEAALSMKKFYRVTSLSSLQSLNPKKVSINLLGDISLHNII

SEQ ID NO: 9677 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMCVLGMEDDEFRDAMEVKDYKTLGAHLYRVQKLASIYYVFRHQYETQLDDSKGAQIMKKFYRAQSFKALFALHPRKVSVSLLGEMALKDD

SEQ ID NO: 9678 - protein, 160 aa, unidentified
  REGION 1..160: note = Description of Unknown:uncultivated organism sequence
AIYRDADGKFHECVVTFWDAVERKKYGIPVIVRNPDEVWDVVIDKNVPEELAAGLPALGWSFVTSLQQNEMFVLGMEDDEFRDAMAEADYKALGAHLYRVQKLAGSDYYFRSHYETLLDDSAGARIMKKFYRVRSFNALFNLHPRKVAVSLLGEMSLKND

SEQ ID NO: 9679 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRINSIKSLFALHPRKVSVSLLGEMALKDD

SEQ ID NO: 9680 - protein, 160 aa, unidentified
  REGION 1..160: note = Description of Unknown:uncultivated organism sequence
AIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 9681 - protein, 160 aa, unidentified
  REGION 1..160: note = Description of Unknown:uncultivated organism sequence
AIYKDADGKYQESIVTFCDAVERKKYGIPVDVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 9682 - protein, 160 aa, unidentified
  REGION 1..160: note = Description of Unknown:uncultivated organism sequence
AIYRDAEGTYHESIVTFLDSVERKKYGLPVIIRKPGEIWDILIDKNIPEELAAGLPAPDWQFVMSMQQNEMFVLGMEDDEFMDAMEVKDYKTLGAHLYRVQNISSLYYVLRLQYETQVDNSNEALNMKKFHRIRSFNALFALHPRKVSVSLLGEMALKDD

SEQ ID NO: 9683 - protein, 158 aa, unidentified
  REGION 1..158: note = Description of Unknown:uncultivated organism sequence
AIYKDADGKYCWNVVTLWNAVDRKRYGLPIIVRNPYEISDIIIDSNVPDELASGLPDPNWSFVMSLQQNEMFVLGMSEEEFRCAIENKDYKTLGMHLYRVQKLSHLRFRSQYETRLDDSNEAKSMKKFYEIRSLKSFWFLNPHKVSISLLGEISLKDD

SEQ ID NO: 9684 - protein, 160 aa, unidentified
  REGION 1..160: note = Description of Unknown:uncultivated organism sequence
AIYRDAEGTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 9685 - protein, 160 aa, unidentified
  REGION 1..160: note = Description of Unknown:uncultivated organism sequence
AIYKDADGKYQESIVTFRDAVERKKYGIPVVVRNPVEVLDTIIDKNVPEDLTGGLPSPEWTFVMSMQQNEMFVLGMGDDEFNDALAGRDYKSLGEHLYRVQKLASSYYVFRSQYETKLDDSKNALMMKKYYRTQSFNALFAINPRKVSISLLGEISLKDD

SEQ ID NO: 9686 - protein, 158 aa, unidentified
  REGION 1..158: note = Description of Unknown:uncultivated organism sequence
AIYIDSDGMYHKSTLTFWKAVERKKYGLPVIIRKPWEIWDIIIDKNIPEELAAGLPAPDWKFVMSMQQNEMFILGMEDDEFRDAMEVKDYKTLGAHLYRVQKLEHLNFRIQYDTILDDSKAAKDMKKFYEIRSFKAFWALHPRKVSVSLLGEMALKDD

SEQ ID NO: 9687 - protein, 160 aa, unidentified
  REGION 1..160: note = Description of Unknown:uncultivated organism sequence
AICRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRVRSFNALFYLHPRKVAVSLLGEMSLKND

SEQ ID NO: 9688 - protein, 158 aa, unidentified
  REGION 1..158: note = Description of Unknown:uncultivated organism sequence
AIYIDSDGVYHKSTITFWKAVERKKYGLPVIIRKPREIWMIIIDKNIPEELAAGLPDPDWKFVMSMQQNEMFVLGMEDDEFRDAMEGKDYKTLGAHLYRVQKLEHLNFRIQYDTILDDSKAAKDMKKFYEIRGFKAFWALHPRKVSVSLLGELSLKDD

SEQ ID NO: 9689 - protein, 160 aa, unidentified
  REGION 1..160: note = Description of Unknown:uncultivated organism sequence
AIYRDADGTYHESVVTFWDTVERKKYGLPVIIRKPEEIWDIIIDKNIPEELAAGLPAPDWKFVMSMQQNEMYVLGMEDDEFRDAMEGKDYKTLGAHLYRVQKLTSLYYVFRHQYETQLDDSKGAQIMKKFYRVRSFNAMFALHPRKVSVSLLGEMALKDD

SEQ ID NO: 9690 - protein, 160 aa, unidentified
  REGION 1..160: note = Description of Unknown:uncultivated organism sequence
AIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIYYVFRHQYETQLDDSKGALVMKKFYRTASFKALFALHPRKVSVSLLGEMALKDD

SEQ ID NO: 9691 - protein, 160 aa, unidentified
  REGION 1..160: note = Description of Unknown:uncultivated organism sequence
AIYKDADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 9692 - protein, 160 aa, unidentified
  REGION 1..160: note = Description of Unknown:uncultivated organism sequence
AIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLASSYYVFRHQYETQLDDSKCAQIMKKFYRAQSFKALFALHPRKVSVSLLGEMALKDD

SEQ ID NO: 9693 - protein, 160 aa, unidentified
  REGION 1..160: note = Description of Unknown:uncultivated organism sequence
AIYKDADGKYQESIVTFRDAVERKKYGIPVVVRNPVEVLDTVIDKNVPEDLAGGLPSPEWTFVMSMQQNEMFVLGMGDDEFNDALAGRDYKSLGEHLYRVQKLATSDYFFRSQYETKLDDSKGASAMRKFYRTASLKALFALNPRKVSISLLGEISLKDD

SEQ ID NO: 9694 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSLYYVFRHQYETQLDDSKGAQIMKKFYRVRSFNAMFALHPRKVSVSLLGEMALKDD

SEQ ID NO: 9695 - protein, 160 aa, unidentified
  REGION 1..160: note = Description of Unknown:uncultivated organism sequence
AIYKDADGKYQESIVTFCDAVERKKYGIPVVVRNPAAVLDTVIDKNVPEDLARGLPSPEWTFVMSMQQNEMFVLGMGDDEFNDAMAEMDYKSLGEHLYRVQKLTSSYYVFRSQYETKLDDSKNALRMKKYYRTQSFNALFSLNPRKVSISLLGEISLKDD

SEQ ID NO: 9696 - protein, 160 aa, unidentified
  REGION 1..160: note = Description of Unknown:uncultivated organism sequence
AIYRDADGKFHECVVTFWDAVERKKYGMPVIVRNPDEVWDDVIDKNVPEELAAGLPALGWSFVMSLQQNEMFILGMEDDEFRDAMAEADYKALGAHLYRVQKLAGSDYYFRSHYETLLDDSAGARIMKKFYRIQSFKALFALHPRKVAVSLLGEMSLKND

SEQ ID NO: 9697 - protein, 160 aa, unidentified
  REGION 1..160: note = Description of Unknown:uncultivated organism sequence
AIYRDADGKFHECVETFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 9698 - protein, 160 aa, unidentified
  REGION 1..160: note = Description of Unknown:uncultivated organism sequence
AIYKDADGKYQESIVTFRDAVERKKYGIPVVVRNPVEVLDTIIDKNVPEELARGLPSPEWTFVMSMQQNEMFVLGMGDDEFNDAMAGRDYKSLGEHLYRVQKLATSDYFFRSQYETKLDDTKNALSMKKYYRTRSFKALFALNPHKVSISLLGEISLKDD

SEQ ID NO: 9699 - protein, 160 aa, unidentified
  REGION 1..160: note = Description of Unknown:uncultivated organism sequence
AIYKDADGKYQESIVTFCDAVERKKYGIPVVVRKPAAVLDTVIDKNVPEDLARGLPSPEWTFVMSMQQNEMFVLGMGDDEFNDALAGRDYKSLGEHLYRVQKLASLYYVFRSQYETKLDDSNNALAMRKFYRVRSFNALFSLNPRKVSISLLGEISLKDD

SEQ ID NO: 9700 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIYYVFRHQYETQLDDSKGAQIMKKFYRAQSFKALFALHQRKVSVSLLGEMALKDD

SEQ ID NO: 9701 - protein, 160 aa, unidentified
  REGION 1..160: note = Description of Unknown:uncultivated organism sequence
AIYRDADGTYHESVVTFWDTVERKKYGLPVIIRKPEEIWDIIIDKNISEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 9702 - protein, 160 aa, unidentified
  REGION 1..160: note = Description of Unknown:uncultivated organism sequence
AIYRDADGKFHECVVTFWDAVERKKCGIPVIVRNPDEVWDVVIDKNVPEELAAGLPALGWSFVMSLQQNEMFIFGMEDDEFMDAMAEADYKALGAHLYRVQKLAGSDYYFRSHYETLLDDSAGARIMKKFYRISSSKALFALHPRKVAVSLLGEMSLKND

SEQ ID NO: 9703 - protein, 160 aa, unidentified
  REGION 1..160: note = Description of Unknown:uncultivated organism sequence
AIYKDAGGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISLLGEISLKDD

SEQ ID NO: 9704 - protein, 160 aa, unidentified
  REGION 1..160: note = Description of Unknown:uncultivated organism sequence
AIYRNVEGTYHESIVTFWDSVERKKYGLPVIIRKPGEIWDILIDKNIPEELAAGLPAPDWQFVMSMQQNEMFVLGMEDDEFRDAMEVKNYKTLGAHLYRVQKLASIDYYFRSQYETALDNSAGARMMKKFYRINSIKSLFALHPRKVSVSLLGEMALKDD

SEQ ID NO: 9705 - protein, 160 aa, unidentified
  REGION 1..160: note = Description of Unknown:uncultivated organism sequence
AIYRDAERTYHENIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 9706 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETTLDDSAGARMMKKFYRIKSIKSLFALHPRKVSVSLLGEMALNDD

SEQ ID NO: 9707 - protein, 160 aa, unidentified
  REGION 1..160: note = Description of Unknown:uncultivated organism sequence
AIYRDADGTYHESVVTFWDTVERKKYGLPVIIRKPEEIWDIIIDKNIPEELAAGLPAPDWQFVMSMQQNEMFVLGMKDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 9708 - protein, 160 aa, unidentified
  REGION 1..160: note = Description of Unknown:uncultivated organism sequence
AIYKNADGKYQESIVTFCDAVERKKYGIPVVVRNPAAVLDTVIDKNVPEDLAGGLPSPEWTFVMSMQQNEMFVLGMGDDEFNDAMTGRDYKSLGEHLYRVQKLASLYYVFRSQYETKLDDSKGALTMKKFYRTASFKALFALNPRKVSISLLGEISLKDD

SEQ ID NO: 9709 - protein, 160 aa, unidentified
  REGION 1..160: note = Description of Unknown:uncultivated organism sequence
AIYKDADGKYQESIVTFRDAVERKKYGIPVVVRNPVEVLDTIIDKNVPEDLAGGLPSPEWTFVMSMQQNEMFVLGMGDDEFNDALAGRDYKSLGEHLYRVQKLASLYYVFRSQYETKLDDSKGALTMKKFYRTASFKALFSLNPRKVSISLLGEISLKDD

SEQ ID NO: 9710 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIYYVFRHQYETQLDDSKGAQIMKKFYRAQSFKALFALHPRKVSVSLLGEMALKDD

SEQ ID NO: 9711 - protein, 160 aa, unidentified
  REGION 1..160: note = Description of Unknown:uncultivated organism sequence
AIYRDAEGTYHENVVTFWDTVERKKYGLPVIIRKPGEIWDILIDKNIPEELAAGLPAPDWKFVMSMQQNEMFVLGMEDDEFRDAMAVKDYKTLGAHLYRVQKLASIDYYFRSQYETALDNSAGARMMKKFYRINSIKSLFTLHPRKVSVSLLGEMALKDD

SEQ ID NO: 9712 - protein, 166 aa, unidentified
  REGION 1..166: note = Description of Unknown:uncultivated organism sequence
AIYCDKKGQYQESVVSFWHAVERKRYGIPVVIEKPQEVWDKLIDIDAIPQDFLENLPKDDWQFVVSLQQNEMFILGMDEADYEAAMEQKDYRTLNKYLYRVQKISSKEYYFRYHTETSVDDKYEGKNNPNISIELQKLKRIKSFGALFSQHPHKVRINLLGEISAL

SEQ ID NO: 9713 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEVKGYKTLGAHLYRVQNISSLYYVLRLQYETQVDNSNEALNMKKFHRIRSFNALFALRPRKVSVSLLGEMALKDD

SEQ ID NO: 9714 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQKLTSIDYYLRSQYETTLDDSAGARMMKKFYRIKSIKSLFALHPRKVSVSLLGEMALKDD

SEQ ID NO: 9715 - protein, 160 aa, unidentified
  REGION 1..160: note = Description of Unknown:uncultivated organism sequence
AIYRDAEGTYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLTSIDYYFRSQYETALDNSAGARMMKKFYRINSIKSLFALHPRKVSVSLLGEMALKDD

SEQ ID NO: 9716 - protein, 128 aa, unidentified
  REGION 1..128: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMK

SEQ ID NO: 9717 - protein, 160 aa, unidentified
  REGION 1..160: note = Description of Unknown:uncultivated organism sequence
AIYRDAEGTYHESIVTFWDSVERKKYGLPVIIRKSGEIWDILIDKNIPEELAAGLPAPDWKFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 9718 - protein, 160 aa, unidentified
  REGION 1..160: note = Description of Unknown:uncultivated organism sequence
AIYKDADGKYQESIVTFCDAVERKKYGIPVVVRNPAAVLDTIIDKNVPEDLAGGLPSPEWTFVMSMQQNEMFVLGMGDDEFNDAMAGMDYKSLGEHLYRVQKLATSDYFFRSQYETKLDDTKNALSMKKYYRTRSFKALFALNPHKVSISLLGEISLKDD

SEQ ID NO: 9719 - protein, 158 aa, unidentified
  REGION 1..158: note = Description of Unknown:uncultivated organism sequence
AFYIDSDGMYHKSTLTFWKAVERKKYGLPVIIRKPGELWDTIIDKNIPEELAAGLPAPDWKFVMSMQQNEMFVLGMEDDEFRDAMEGKDYKTLGAHLYRVQKLEHLNFRIQYDTILDDSKAAKDMKKFYEIRSFKAFWALHPRKVSVSLLGEMALKDD

SEQ ID NO: 9720 - protein, 160 aa, unidentified
  REGION 1..160: note = Description of Unknown:uncultivated organism sequence
AIYRDADGKFHECVVTFWDAVERKKYGIPVIVRNPDEVWDVVIDKNVPEELAAGLPALGWSFVMSLQQNEMFILSMEDDEFRDAMAEADYKALGAHLYRVQKLTGSDYYFRSHYETLLDDSAGARIMKKFYRVRSFNALFNLHPRKVSVSLLGEMALKDD

SEQ ID NO: 9721 - protein, 160 aa, unidentified
  REGION 1..160: note = Description of Unknown:uncultivated organism sequence
AIYKDADGKYQESIVTFRDAVERKKYGIPVVVRNPVEVLDTIIDKNVPEDLAGGLPSPEWTFVMSMQQNEMFVLGMGDDEFNDAMVGMDYKSLGEHLYRVQKLASLYYVFRSQYETKLDDSNNALAMRKFYRVRSFNALFSLNPRKVSISLLGEISLKDD

SEQ ID NO: 9722 - protein, 160 aa, unidentified
  REGION 1..160: note = Description of Unknown:uncultivated organism sequence
AIYKDADGKYQESIVTFRDVVERKKYGIPVVVRNPAAVLDTIIDKNVPEDLAGGLPSPEWTFVMSMQQNEMFVLGMGDDEFNDAMSGMDYKSLGEHLYRVQKLASLYYVFRSQYETKLDDSKGALTMKKFYRTASFKALFALNPRKVSISLLGEISLKDD

SEQ ID NO: 9723 - protein, 160 aa, unidentified
  REGION 1..160: note = Description of Unknown:uncultivated organism sequence
AIYKDAEGTYHESIVTFWDSVERKKYGLPVIIRKPGEIWDIIIDKNIPEELAAGLPAPDWQFVMSMQQNEMFVLGMEDDGFRDAMEVKDYKTLGAHLYRVQKLTSIDYYFRSQYETTLDDSAGARMMKKFYRIKSIKSLFALHPRKVSVSLLGEMALKDD

SEQ ID NO: 9724 - protein, 160 aa, unidentified
  REGION 1..160: note = Description of Unknown:uncultivated organism sequence
AIYRDADGTYHESVVTFWDTVERKKYGLPVIIRKPEEIWDIIIDKNIPEELAAGLPAPDWKFVMSMQQNEMYVLGMEDDEFRDAMEVKDYKTLGAHLYRVQKLTSIDYYFRSQYETTLDDSAGARMMKKFYRIKSIKSLFALHPRKVSVSLLGEMALKDD

SEQ ID NO: 9725 - protein, 160 aa, unidentified
  REGION 1..160: note = Description of Unknown:uncultivated organism sequence
AIYKDADGKYQESIVTFRDAVERKKYGIPVVVRNPVEVLDTVIDKNVPEDLAGGLPSPEWTFVMSMQQNEMFVLGMGDDEFNDAFAGRDYKSLGEHLYRVQKLASLYYVFRSQYETKLDDSNNALAMRKFYRVRSFNALFSLNPRKVSISLLGEISLKDD

SEQ ID NO: 9726 - protein, 160 aa, unidentified
  REGION 1..160: note = Description of Unknown:uncultivated organism sequence
AIYRDADGAYHENVVTFWDTVERKKYGLPVIIRKPGEIWDILIDKNIPEELAAGLPAPDWKFVMSMQQNEMFVLGMEDDEFRDAMEVKDYKTLGAHLYRVQKLASSYYVFRHQYETQLDDSKCAQIMKKFYRAQSFKALFALHPRKVSVSLLGEMALKDD

SEQ ID NO: 9727 - protein, 160 aa, unidentified
  REGION 1..160: note = Description of Unknown:uncultivated organism sequence
AIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 9728 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLACIYYVFRHQYETQLDDSKGAQIMKKFYRAQSFKALFALRQRKVSVSLLGEMALKDD

SEQ ID NO: 9729 - protein, 160 aa, unidentified
  REGION 1..160: note = Description of Unknown:uncultivated organism sequence
AIYKDADGTYHENVVTFWDTVERKKYGLPVIIRKPGEIWDILIDKNIPEELAAGIPAPDWKFVMSMQQNEMFVLGMEDDEFRDTMEVKDYKTLGAHLYRVQKLTSIYYVFRHQYETQLDDSKGAQIMKKFYRAQSFKALFSLHPRKVSVSLLGEMALKDD

SEQ ID NO: 9730 - protein, 160 aa, unidentified
  REGION 1..160: note = Description of Unknown:uncultivated organism sequence
AIYKDADGKYQECIVTFRDAVERKKYGIPVVVRKPAAVLDTVIDKNVPEDLAGGLPSPEWTFVMSMQQNEMFVLGMGDDEFNDAMAGRDYKSLGEHLYRVQSISHADYYFRSQYETMLDNSKNAMAMKKYYRIRSFKALFALNPRKVSISMLGEISLKDD

SEQ ID NO: 9731 - protein, 160 aa, unidentified
  REGION 1..160: note = Description of Unknown:uncultivated organism sequence
AIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 9732 - protein, 160 aa, unidentified
  REGION 1..160: note = Description of Unknown:uncultivated organism sequence
AIYRDADGKFHECVVTFWDAVERKKCGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRIQSFKALFALHPRKVAVSLLGEMSLKND

SEQ ID NO: 9733 - protein, 160 aa, unidentified
  REGION 1..160: note = Description of Unknown:uncultivated organism sequence
AIYKDADGKYQESIVTFRDAVERKKYGIPVVVRNPVEVMDTVIDKNVPEDLAGGLPSPEWTFVMSMQQNEMFVLGMGDDEFNDAMAGMDYKSLGEHLYRFQSISHADYYFRSQYETMLDNSKNAMAMKKYYRIRSFKALFALNPRKVSISLLGEISLKDD

SEQ ID NO: 9734 - protein, 160 aa, unidentified
  REGION 1..160: note = Description of Unknown:uncultivated organism sequence
AIYKDADGKYQESIVTFCDAVERKKYGIPVVVRNPVEALDTIIDKNVPEDLAGGLPSPEWTFVMSMQQNEMFVLGMGDDEFNDALAGMDYKSLGEHLYRVQKLATSDYFFRSQYETKLDDSKGASAMRKFFRTASLKALFALNPRKVSISLLGEISLKDD

SEQ ID NO: 9735 - protein, 160 aa, unidentified
  REGION 1..160: note = Description of Unknown:uncultivated organism sequence
AIYRDADGAYHENVVTFWDTVERKKYGLPVIIRKPGEIWDILIDKNIPEELAAGLPAPDWQFVMSMQQNEMFVLGMEDDEFRDAMEVKDYKTLGAHLYRVQKLASIDYYFRSQYETALDNSAGARMMKKFYRTNSIKSLFALHPRKVSVSLLGEMALKND

SEQ ID NO: 9736 - protein, 160 aa, unidentified
  REGION 1..160: note = Description of Unknown:uncultivated organism sequence
AIYRDADGTYHENVVTFWDTVERKKYGLPVIIRKPGEIWDIIIDKNIPEELATCLPAPDWQFVMSMQQNEMFVLGMEDDEFRDAMEGKDYKTLGAHLYRVQKLTSIDYYFRSQYETTLDDSAGARMMKKFYRIKSIKSLFALHPRKVSVSLLGEMALKDD

SEQ ID NO: 9737 - protein, 160 aa, unidentified
  REGION 1..160: note = Description of Unknown:uncultivated organism sequence
AIYRDADGKFHECVVTFWDAVERKKYGIPVIVRNPDEVWDVVIDKNVPEELAAGLPALGWSFVMSLQQNEMFILGMEDDEFMDAMAEADYKALGAHLYRVQKLAGSDYYFRSHYETLLDDSAGARIMKKFYRISSSKALFALHPRKVAVSLLGEMSLKND

SEQ ID NO: 9738 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEVKDYKTLGAHLYRVQSLSRSDYYYRCQYETQLDNSNGAMLMKKYYRVRSFNALFTLHPRKVSVSLLGEMALKDD

SEQ ID NO: 9739 - protein, 160 aa, unidentified
  REGION 1..160: note = Description of Unknown:uncultivated organism sequence
AIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQSLSRSDYYYRCQYETQLDNSNGAMRMKKFYRVRSFNALFNLHPRKVAVSLLGEMSLKND

SEQ ID NO: 9740 - protein, 160 aa, unidentified
  REGION 1..160: note = Description of Unknown:uncultivated organism sequence
AIYKDADGKYQECIVTFRDAVERKKYGIPVVVRNPVEALDTIIDKNVPEDLAGGLPSPEWTFVMSMQQNEMFVLGMGEDEFNDAMAGMDYKSLGEHLYRVQKLASSDYFFRSQYETKLDDTKNALLMKKYYRTRSFKALFALNPHKVSISLLGEISLKDD

SEQ ID NO: 9741 - protein, 160 aa, unidentified
  REGION 1..160: note = Description of Unknown:uncultivated organism sequence
AIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLAGSDYYFRSHYETLLDDSAGARIMKKFYRISSSKALFALHPRKVAVSLLGEMSLKND

SEQ ID NO: 9742 - protein, 164 aa, unidentified
  REGION 1..164: note = Description of Unknown:uncultivated organism sequence
AIYLDEKGELKECIYTFWQAVERSKYKLPLIIKEPKSLWDEILERENNGEIFPDTLITSLPSPNWTFVESLQLNDMFVMDMDDVKFENFISSNNYEEIGKRIYRVQSLSSHDYVFRHHTDTTSSMMPEAALCRKFIRIKSLKAYIEHHPHKVQLSLLGKILTKR

SEQ ID NO: 9743 - protein, 158 aa, unidentified
  REGION 1..158: note = Description of Unknown:uncultivated organism sequence
AIYSDKNGNLHEHTVTFWHAVERKKYGIPVIIENPQSVWDSIIDKQLPESFLENLPDVKWTFEISLQQNEMFVLGMENESFEDAVRNNDFSTISKYLYRVQSISESDYWFRLHIETQNDKTPSAKLANKYHRVKSLKSFHELNPHKVYISVIGKIKAL

SEQ ID NO: 9744 - protein, 159 aa, unidentified
  REGION 1..159: note = Description of Unknown:uncultivated organism sequence
AIYRDQDGNRSEHVVSFWHAVERKRYGLPVIIRDTDSVWEQIEGESLPESFLKNLPQPGLKLELSLQQNEMLILGMKEDEFNDAIREKDTRRLNKHLYRVQKLSTMYYVFRYHTETQIDDSKGALEMHKFYRTVSFRALDALFPRKVRISVTGELIPIQ

SEQ ID NO: 9745 - protein, 158 aa, unidentified
  REGION 1..158: note = Description of Unknown:uncultivated organism sequence
CYYRNKNGELFEHIVSFWHAVDRKKYGIPVIIEDTDVLWEDMANRDLPQDFLKNLPPAGLKLEVSLQQNEMFVLGMPEEDFQNAIKENDQRALNKYLFRVQKISGQYNVFRRNTDTGKDEDSKAQSLGQFVRISSVRGWIHCCPHKVRISVLGEISEI

SEQ ID NO: 9746 - protein, 166 aa, unidentified
  REGION 1..166: note = Description of Unknown:uncultivated organism sequence
AIYQDKDGQYQEMVVSFWDAVERKKYGVPSVITNPRELWNSIMDIDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 9747 - protein, 160 aa, unidentified
  REGION 1..160: note = Description of Unknown:uncultivated organism sequence
AIYQDNEGNLREHSVTFWHAVERKKYGVPVIIDNPIQVWDSIKDRQLPESFLEKLPEVNWTYKISLQQNEMFILGMEDDAYDYAIRNQDYSTLGQYLYKVQNVSEKQYRFSLHNMTKFDIKRMNKADKCFYNIQSIDALFRLHPHKVHISLIGKIKEIQE

SEQ ID NO: 9748 - protein, 158 aa, unidentified
  REGION 1..158: note = Description of Unknown:uncultivated organism sequence
CFYRNRDGELVGHLVSFWHAVERKKYGIPVIIKDTDRLWEEVANRDLPEDFLKNLPPSGLTLEVSLQQNEMFILGMPEEDYQRAIEKSSKNDLNKYLYRVQKISGQYNVFRRNTDTGKEEDSIAQSLGQFIRISSTKGWISYNPHKIHIDILGDICEL

SEQ ID NO: 9749 - protein, 169 aa, unidentified
  REGION 1..169: note = Description of Unknown:uncultivated organism sequence
AIYKEKDKKTFDITVSFYDAVERKRYGVPVVITNPHEVWDSVLNKDLPQEFLAKLPNDNWQFILSMQENEMFVLGMEDDEFDDAIERQDYATLNKHLYRVQKIAHNDYWFRYHTETTVDDKYGDGEDNKVNLGWSVEMGKVCRIRSCDALFAKHPHKVKVDLLGHIHKA

SEQ ID NO: 9750 - protein, 166 aa, unidentified
  REGION 1..166: note = Description of Unknown:uncultivated organism sequence
AIYQDKDGQYQEMVVSFWNAVERKRYGVPVVITNPHEVWDSLLNKDLPQEFLAKLPNDNWQFILSMQENEMFVLGMENDEFNDAIERQDYATLNKHLYRVQKLSTHDYSFRYHTETKVDDKYEGAENGRNASMSLGALVPIRSCGSLFVQFPHKVKVDILGHIHKA

SEQ ID NO: 9751 - protein, 162 aa, unidentified
  REGION 1..162: note = Description of Unknown:uncultivated organism sequence
AIYSDEKGEYKECVYTFWQAVERSKYRLPLIIKEPHELWREIMKRENDGEHFPDSIIEALPSPNWTFIESLQLNDMFVMDLDDETFEEYITNKNYEKLGKKLYRVQSLSTGDYCFRHHTDTTTDRTNAKLTKKFLRKSLMSFISSNPRKVQISLLGKINRDC

SEQ ID NO: 9752 - protein, 158 aa, unidentified
  REGION 1..158: note = Description of Unknown:uncultivated organism sequence
AIYQDEEGNLKEHSVTFWHAVERKKYGIPVIIENPTKLWDEIKDKQLPESFMEKLPEVNWTFKVSLQQNEMFILGMEDDTYDVAMGNKDFTLISKFLYRVQSISESDYWFRLHIESQNDKTPQAKQAKKFHRIQSLKGFYQLHPHKVHISVIGKIKEL

SEQ ID NO: 9753 - protein, 166 aa, unidentified
  REGION 1..166: note = Description of Unknown:uncultivated organism sequence
AIYQDKDGQYQEMVVSFWDAVERKKYGVPVVITNPRAVWDSIMDKDMPQEFLEKLPNDDWTYILSMQENEMFVLGMEEDEYNDAIEAKDYAALNKHLYRIQNISSLFYIFRYHTETKVDDKYEGIANGRNASMSLGALIPIRSFKALFAQFPHKVKIDIMGRITRA

SEQ ID NO: 9754 - protein, 158 aa, unidentified
  REGION 1..158: note = Description of Unknown:uncultivated organism sequence
CYYRNENGELFEHIVSFWHAVDRKKYGIPVIIEDTDVLWDEMANRDLPQDFLKYLPPVGLKLEVSLQQNEMFILGMKDEDYERSIKEKDLRMLNQYLYRVQKISSQYIVFRRNTDTGKDEDSKAQSIGQFVRVSSIKGWIQCNPHKIRVNVLGEISEI

SEQ ID NO: 9755 - protein, 166 aa, unidentified
  REGION 1..166: note = Description of Unknown:uncultivated organism sequence
AIYQDKDGQYQEMVVSFWDAVERKKYGVPSVITNPRELWNSIMDKDLPQEFLLKLPQDDWQYVLSMQENEMFVLGMEEDEFHDALERHDYCSLNKHLYRVQKISHGEYVLRYHTETKVDDKYKGVEKGRDASLKLGALVSIRSFGSLFSKFPHKVKIDIMGRITKA

SEQ ID NO: 9756 - protein, 156 aa, unidentified
  REGION 1..156: note = Description of Unknown:uncultivated organism sequence
AIYKDENGNLQESVVTFWHAVERKKYGLPIIITNPAEVWEIAKAKDCPSEFLACLPNEKWSFVQSLQINEMFIMGLDDETYEKTLSEHNYTLINQHLYRVQKLTSNDYFLRFHLETKIDDSAEAKQMGKVLRKSLKTFIQDNPHKVKVSVLGKLIT

SEQ ID NO: 9757 - protein, 160 aa, unidentified
  REGION 1..160: note = Description of Unknown:uncultivated organism sequence
AIYRDKEGNRFEHVVSFWHAVERKRFGLPVIIQDTDSVGDQIQGISLPESFLKNLPAPGATLELSLQQNEMFILGMKEDEFNDAIREKDNTALNKHLYRVQKLGSLYYVFRYHTETQIDDSNNAIIMHKFYRCRSLSAFDALNPHKVRVSITGEIMQGDD

SEQ ID NO: 9758 - protein, 165 aa, unidentified
  REGION 1..165: note = Description of Unknown:uncultivated organism sequence
AIYQDKNGQYQEMVVSFWDAVERKKYGIPVVITNPHAVWDSVLDKESPQEFLEKLPNDDWKYILSMQENEMFVLGMEDGDFEHAIETQNYAALNKHLYRVQKVSSKFWCFRYHTETMVDDKYGDTKNEQWSFQMGKAFRASSFDGLFRQFPHKVKIDIMGRITKA

SEQ ID NO: 9759 - protein, 158 aa, unidentified
  REGION 1..158: note = Description of Unknown:uncultivated organism sequence
AFYKNENGLIEERIVTKWHAVQRKLHHVPIIIDNPSATWSDMLGRTDVPEEILKELPKDNSIFMLSLQIGEAFVMGMEESDYQKAIEEGNKQVLAEHLYFVQNLSSSNYRLRRHVESSYDITGMNKEDQRFLNIKSIGALFNYNPHKVKITVLGDIIP

SEQ ID NO: 9760 - protein, 158 aa, unidentified
  REGION 1..158: note = Description of Unknown:uncultivated organism sequence
AFYKDKDGVITESIVTKWQAVQRKLKHIPVIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 9761 - protein, 169 aa, unidentified
  REGION 1..169: note = Description of Unknown:uncultivated organism sequence
AIYKDKDGQYQEMVVSFWDAVERKKYGVPVVITNPHDVWDSIMDKDMPQEFLEKLPKDDWSYLLSMQENEMFVLGMEEDEFNDAIEAKDYATLNKHLYRVQKVARNDYWFRYHTETTVDDKYGEGDESKVNLGWSVEMGKVYRVRSCGALFDLFPHKVKIDIMGRITKA

SEQ ID NO: 9762 - protein, 158 aa, unidentified
  REGION 1..158: note = Description of Unknown:uncultivated organism sequence
AIYRQKDGSLKEKIVSFWDAVERKRYGVPVVIANPHEVWDSLLNTEFPQEFLAKLPKDDWQYVLSMQENEMFVLGMEDDEFNDAIERQDYTALNKHLYRVQSISHDDYYFCHHTETKATEKSESLKLGKTLRIRGVNSLKNYFPHKVKVDILGHIHKV

SEQ ID NO: 9763 - protein, 165 aa, unidentified
  REGION 1..165: note = Description of Unknown:uncultivated organism sequence
ALYKDENGKFQECIYTFWQVVERSKFKLPLIITDTKALWNEIQQRENKGDTFPDSLIQSLPLPNWTFIESLQLNDMFVMDINDDDFEHYIATNNYEELGKKLYRIQNISSFDYSFRLHTDTTSKTTSDAALSKRYIRIKSIKAYIEHNPHKVKISLLGKIIRNTE

SEQ ID NO: 9764 - protein, 166 aa, unidentified
  REGION 1..166: note = Description of Unknown:uncultivated organism sequence
AIYTDKSGKPQESVVSFWDAVERKRYGVPVVITNPHEVWDNLLNTDFPQEFLAKLPEDDWQYLFSMQENEMFVLGMEDDEFYDAIERQDYASLNKHLYRVQKIRSGEYTFRYHTETKVDDKYEGVANGTNTSFQLGALVSIRGFSSLFAKHPHKVKVDILGHIHKA

SEQ ID NO: 9765 - protein, 158 aa, unidentified
  REGION 1..158: note = Description of Unknown:uncultivated organism sequence
AFYKDKDGVITESIVTKWQAVQRKLNHIPIIVDNPTQTWNDLVGRNDVPEELLQSLPKDNSEFLLSLQIGEAFIMGMEDADFHRAIEEKDIHNLAEHLYFVQNISSNNYRMRRHVEASFDTSDMNKEDQRFLNVSSIGAFFNYNPHKVKVTILGDIIK

SEQ ID NO: 9766 - protein, 158 aa, unidentified
  REGION 1..158: note = Description of Unknown:uncultivated organism sequence
AFYKDENGVITETIVTKWQAVQRKLYHIPIIIDNPSQTWNEVLERKDIPEELLQSLPKDSFTFLLSLQIGEAFIMGMEEADYQRALEEKDMQTLAKHLYFVQSISSCDYRFRRHVEAQYDTNDINKEDLRFLRIRNLQALFEYNPQKVKVTVLGDLIH

SEQ ID NO: 9767 - protein, 160 aa, unidentified
  REGION 1..160: note = Description of Unknown:uncultivated organism sequence
AFYKDENDVITENIVTKWLAVQRKLNHMPIIIDNPSQTWSEILKRNDVPEELLQSLPKDSSTFLLSLQIGEAFIMGMEDGDYQKALEEKDMQTLADHLYFVQNISSNNYRLRRHVESSFDTTDMNKEDQRFLNIKSVNSFFNSNPHKVKITILGDIITDV

SEQ ID NO: 9768 - protein, 167 aa, unidentified
  REGION 1..167: note = Description of Unknown:uncultivated organism sequence
AIYQDKDGQYQEMVVSFWDAVERKRYGVPVVITNPHEVWDSLLNKDLPQEFLAKLPNDNWQFVLSMQENEMFVLGLEDDEFNDAIERQDYAALNKHLYRVQKISHREYTFRYHTETKVDDKYEGMENGRTTSISLGASIPFKSISALLAKFPHKVKVDLLGHIHSKK

SEQ ID NO: 9769 - protein, 158 aa, unidentified
  REGION 1..158: note = Description of Unknown:uncultivated organism sequence
AFYKDEDDEKKEIVVTKLLAVQRKLNHIPIIIDNPSQTWSEVLGRNDVPEELLQSLPKDKSIFLLSLQKGEAIIMGLEEMDYQRAILAKDMRTLCNHLFYVQSASSRDYRFRRHVEVKYDTKDINKDDMRFLRIRTINELFKINPHKVKVTVLGDIIE

SEQ ID NO: 9770 - protein, 166 aa, unidentified
  REGION 1..166: note = Description of Unknown:uncultivated organism sequence
AIYADENGKYKECIYTFWQAVERSKYRLPLIIKDPKALWDEITQRENNGENFPDSLIKSLPMRDWTFIESLQSNDMFVMDMDDNDFEICISTNNYEELGKHIYRIQSISTLDYFFRLHTDTTSTTTPEAALSKRFIRIKSFKSYIAHNPHKIQVSLLGKIFTNQND

SEQ ID NO: 9771 - protein, 166 aa, unidentified
  REGION 1..166: note = Description of Unknown:uncultivated organism sequence
AIYKDENGTLQESVVTFWHAVERKKYGLPIIVTKPAEAWKLAIEKNCPKEFLDCLPKENWTFVESLQVNEMFVIGMNDEEFGNAIVDKDYALLNQHLYRVQKITTKEYCFRLHTETKVDDKYKGVKDAMKSKAMGKLKMIQSMDSWQKANPHKVKISLLGKLITRE

SEQ ID NO: 9772 - protein, 158 aa, unidentified
  REGION 1..158: note = Description of Unknown:uncultivated organism sequence
AIYRDKEGKLKEHAVTFWHAVERKKYGIPVVIENPLEVWDSIRDKQLPETFLEKLPDINWTFEMSLQQNEMFVLGMEDDTFENAMRDKEYDLISNYLYRVQSISESDYWFRLHLETQNDKTTSAKLAKKYYRTKSIKGFYSLNPHKVYISVIGKIKEL

SEQ ID NO: 9773 - protein, 158 aa, unidentified
  REGION 1..158: note = Description of Unknown:uncultivated organism sequence
AFYKDENGVITESIVTKWLAVQRKLNHIPIIIDNPSQTWCEVLERNDVPEELLQSLPKDNSTFLLSLQIGEAFIMGMEDADYQKALLAKDVRTLCDHLFYVQNASSHDYRFRRHVEAKYDTNDMNKDDMRFLRIRTIDDLFNNNPHKVKVTVLGVIVE

SEQ ID NO: 9774 - protein, 158 aa, unidentified
  REGION 1..158: note = Description of Unknown:uncultivated organism sequence
AIYRDKEGKLKEHAVTFWHAVERKKYGIPVVIENPLEVWDSIRDKQLPETFLEKLPDINWTFEMSLQQNEMFVLGMEDDTFENAMRDNDYAKLGQYIYKVQNISEKQYRFSLHTATKFDVKRMNKTDKSFYNIRSLDALFALHPHKVYISVIGKIKEL

SEQ ID NO: 9775 - protein, 160 aa, unidentified
  REGION 1..160: note = Description of Unknown:uncultivated organism sequence
AFYKNENGVISETIVTKWQAVQRKVNHIPIIIDNPSQTWSKVLGRNNVPEELLQSLPRDSSSFLLSLQIGEAFIMGMEEAEFQKALEEKDMQTLAEHLYFVQNISSNNYRMRRHVESSFDTTDMNKEDQRFFNIQSISSFFNSNPHKVKITILGDIVVDV

SEQ ID NO: 9776 - protein, 158 aa, unidentified
  REGION 1..158: note = Description of Unknown:uncultivated organism sequence
AFYMYQDGERTESVVTKWQAVQRKLNHIPIIIDNPSQTWNEVLGRNDVPDELLQSLPQDKSIFLLSLQKGEAVVMGLEEMNYQRALEKKDMRTLCNHLFYVQSASSHDYRFRRHVEAKYDTKDMNKDDMRFLRIRTVDELFKNNPHKVKVTVLGDIVE

SEQ ID NO: 9777 - protein, 158 aa, unidentified
  REGION 1..158: note = Description of Unknown:uncultivated organism sequence
AFYKDEDGVVTESLVTKWQAVQRKLNHIPIIIENPSQVWNEVLGTNDIPNELLQSLPKDKSIFLLSMQIGEAFVMGMDETAYKRAIEKNDTQALADHLYFVQNLSSNNYRLRRHVESSFDTTDMNKEDLRFLNVKSIGALFNYNPHKVKLTILGDIIL

SEQ ID NO: 9778 - protein, 158 aa, unidentified
  REGION 1..158: note = Description of Unknown:uncultivated organism sequence
AFYKDENGVISETIVTKWQAVQRKLNHIPIIIDNPSQTWSEVLGRNNVPEELLQSLPKDSSSFLLSLQIGEAFIMGMEEAELQKALEEKDMQKLAEHLYFVQNISSNNYRMRRHVESSFDTTDMNKEDQRFLNISSLDALYRLNPHKVKLTVLGDIVP

SEQ ID NO: 9779 - protein, 158 aa, unidentified
  REGION 1..158: note = Description of Unknown:uncultivated organism sequence
AFYKDKDGVITESIVTKWQAVQRKLKHIPVIVDNPTQTWNDLVGRNDVSEELLQSLPKDNSEFLLSLQKGEAVILGLEEAAYQKAIDSNDMHTLSNHLYFVQSASLSDYRFRRHVESSFDKMGMNKEDQRFLNVKSIGAFFNYNPHKVKVTILGDIIK

SEQ ID NO: 9780 - protein, 170 aa, unidentified
  REGION 1..170: note = Description of Unknown:uncultivated organism sequence
AIYQDAKGQYQESVVSFWQAVERKRYGLPIVIEDPKAIWDKLLDSDLPQEFLSTLPQDDWQFVVSLQANEMFILGMEDGDFEMAMQNKDYQLLNKYLYRVQKIRGKEYTFRYHIETTVDDKYSNEKGESKPNPALSMQMKKLISIRSFGGWLAQHPHKVRVNLLGEISEV

SEQ ID NO: 9781 - protein, 166 aa, unidentified
  REGION 1..166: note = Description of Unknown:uncultivated organism sequence
AIYRDANGQFQESVVSFWQAVERKRYGIPVVIEHPHEVWDKLINIDNIPQEFLETLPRDDWQFVVSLQQNEMFILGMDDADFEAAMEQKDYRTLNKYLYRVQKIATKNYYFRYHTETSVDDKYDGEKNEMWSKNMKKLINIRSFDAFFSQHPHKVRINLLGEVSAL

SEQ ID NO: 9782 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLASIDYYFRSQYETALDNSAGARMMKKFYRINSIKSLFALHPRKVSVSLLGEMALKDD

SEQ ID NO: 9783 - protein, 158 aa, unidentified
  REGION 1..158: note = Description of Unknown:uncultivated organism sequence
AIYKDADGTYYWKLVTLWNAVDRKRYGLPIIVRNPYEISDIIIDSNIPDALASGLPEPNWSFVMSLQQNEMFVLGMSEEEFRCAIENKDYKTLGMHLYRVQKLSHLRFRSQYETRLDDSSEAKNMKKFYEIRSLKSFWSLNPRKVSISLLGEISLKDD

SEQ ID NO: 9784 - protein, 160 aa, unidentified
  REGION 1..160: note = Description of Unknown:uncultivated organism sequence
AIYRDAEGTYHESIVTFWDSVERKKYGLPVIIRKPGEIWDILIDKNIPEELAAGLPAPDWQFVMSMQQNEMFVLGMEDDEFRDAMEGKDYKTLGAHLYRVQKLTSIDYYFRSQYETTLDDSAGARMMKKFYRITSIKSLFALHPRKVSVSLLGEMALKDD

SEQ ID NO: 9785 - protein, 160 aa, unidentified
  REGION 1..160: note = Description of Unknown:uncultivated organism sequence
AIYRDADGKFHECVVTFWDAVERKKYGIPVIVRNPDEVWDVVIDKNVPEELAAGLPALGWSFVMSLQQNEMFILGMEDDEFRDAMAEADYKALGAHLYRVQKLTGSDYYFRSHYETLLDDSAGARIMKKFYRVRSFNALFNLHPRKVAVSLLGEMSLKND

SEQ ID NO: 9786 - protein, 160 aa, unidentified
  REGION 1..160: note = Description of Unknown:uncultivated organism sequence
AIYRDADGKFHECVVTFWDAVERKKWGIPVIVRNPDEVWDVVIDKNVPEELAAGLPALGWSFVMSLQQNEMFVLGMEDDEFRDAMAEADYKALGAHLYRVQKLAGSDYYFRSHYETLLDDSAGARIMKKFYRISSSKALFALHPRKVAVSLLGEMSLKND

SEQ ID NO: 9787 - protein, 169 aa, unidentified
  REGION 1..169: note = Description of Unknown:uncultivated organism sequence
AIYKSDNDKPFDQVVSFWDAVERKRYSVPIVIDNPHEVWDGLLNRDMPQEFLDKLPHDDWQFVLSMQENEMFVLGLEDDEFNDAIERQDYNSLNKHLYRVQKITHNDYWFRFHTETTVDDKYGDQENQVVNVAWSTEMKKVFRFKSQGALFAQFPHKVKIDIMGRITKA

SEQ ID NO: 9788 - protein, 160 aa, unidentified
  REGION 1..160: note = Description of Unknown:uncultivated organism sequence
AFYKDENGVIKESIVTKWQAVQRKLNHIPIIIDNPSQTWSEVLGRNDVPEELLQSLPKDSSTFLLSLQIGEAFIMGMEDSDYQKALEERDMRTLSEHLYFVQNISSNNYRLRRHVESSFDITDMNKEDQRFLNIKSVNSFFNNNPHKVKITILGDIIADL

SEQ ID NO: 9789 - protein, 166 aa, unidentified
  REGION 1..166: note = Description of Unknown:uncultivated organism sequence
AIYRDKSGKYQEMVVSFWDAVERKKFGVPVVISNPHDVWDSIMDKDLPQEFLVKLPKDDWTYILSMQENEMFVLGMEEDEFNDAIEAKDNAVLNKHLYRIQNISSLFYNFRYHTETKVDDKYAGIENGRNASMSLGALVPIRSFGSLFALFPHKVKIDIMGRITKA

SEQ ID NO: 9790 - protein, 158 aa, unidentified
  REGION 1..158: note = Description of Unknown:uncultivated organism sequence
AFYKDEDGVITESIVTKWQAVQRKLNHIPIIIDNPSQTWNEVIGRNDIPDELLQTLPKDKSTLMLSLQIGEALIMGMEEADYQKAIEEKNMLALAEHLYFVQNISIGNYRLRRHVETSYDVKDMNKEDLRFLNIASIAALFNYNPHKVKITVLGDIIP

SEQ ID NO: 9791 - protein, 164 aa, unidentified
  REGION 1..164: note = Description of Unknown:uncultivated organism sequence
AIYKDANGKYKESVVSFTEAVHRKLIGLPIVIDNPKQVWDKVINMNLPEDYLLTLPQDNWEFVVSMQVNDMFIMGLTDVEFEDAIHEKDYALLNQHLYRVQKLSSTKYYFRYHLETSVDDKYDGVANEKLSMEIGKLINLRSPNAMAVNVHKVRISILGEITPL

SEQ ID NO: 9792 - protein, 165 aa, unidentified
  REGION 1..165: note = Description of Unknown:uncultivated organism sequence
AIYVDEKGEYQECVYTFWQVVERAKYRLPLIIQDPKTIWDEIRQREKDGDSFPDDLITSLPLPNWTFVESLQQNDMFVMDMDDDTFKENVTSNNYKELGEKLYRVQNLSTHDYFFRLHSDTTSKTTPDLAQCKKFIRIKSFKAYFEHNPHKVQLSLLGKIILKND

SEQ ID NO: 9793 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNDYCFTRHTETKYDKKHTNKADERFMRYASASSLLRDFTAKVSINVIGDIIEK

SEQ ID NO: 9794 - protein, 165 aa, unidentified
  REGION 1..165: note = Description of Unknown:uncultivated organism sequence
AIYQDAKGQYQESVVSFWQAVERKRYGLPIVIEDSKAIWDKVMDMDLPQEFLETLPKDDWQFVVSLQANEMFILGLEDADFEMAMENRDYQLLNKHLYRVQKIGSKDYSFRHHIETSVDDKYDGMQNRQLSVTMKKLYRFNSIGAFNTQHPHKVRVNLLGEISEV

SEQ ID NO: 9795 - protein, 165 aa, unidentified
  REGION 1..165: note = Description of Unknown:uncultivated organism sequence
AIYRDKEGNLQEHVVTFWTAVERKKYGIPVIIKSPVDVWDRLTDRDIPEAFLATLPNVSWEFVESMQVNEMFILGLSDDEFNDAISNNDKVTLCNHLYRVQKIAYLYYSFRLHIETSVDDKYNGVKDESLSISLGKYKRVRSLNGLVNLNPHKIKITNLGDIIVE

SEQ ID NO: 9796 - protein, 165 aa, unidentified
  REGION 1..165: note = Description of Unknown:uncultivated organism sequence
AIYQDANGQYQELVVSFWQAVERKRYGLPIVIEDPKAVWDRVMDMDLPQAFLETLPKDNWQFVVSLQANEMFILGLEDGDFEMAMENKDYQLLNKHLYRVQKIGSKDYSFRYQIETSVDDKYDGVHNRALSLTMKKLISIRSFGSWFAQYPHKVRVNLLGEIAEV

SEQ ID NO: 9797 - protein, 165 aa, unidentified
  REGION 1..165: note = Description of Unknown:uncultivated organism sequence
AIYQDKNGQYQESVVSFWQAVERKRYGLPIVIEDPKAIWDKVMDMDLPQEFLETLPKDDWQFVVSLQANEMFILGMEDGDFEMAMENRDYQLLNKHLYRVQKMSSKDYSFRHHIETTVDDKYDDKPNRALSLQMKKLISIRSFGGWLAQHPHKVRVNLLGEISEV

SEQ ID NO: 9798 - protein, 157 aa, unidentified
  REGION 1..157: note = Description of Unknown:uncultivated organism sequence
AIYRDGEGKLHEHLVTFWHAVERKKYNVPVIVKNTVEMWNDLSSKDLPESFLSHLPEYGWEFVESLQQNEMFVLGMSEDAYNDAVRNNDYSAINKYLYRVQKLRKGEYYFRFHVETQLDDTSAAKEMCKFYSIRSFGAFKALNPHKVKVSTIGKLII

SEQ ID NO: 9799 - protein, 157 aa, unidentified
  REGION 1..157: note = Description of Unknown:uncultivated organism sequence
AIYKDQDGKKHEMVVNFWEAFKRVKAGLPLIIKDVKGLSSAIEEGKISNLPDDLKLPDYNWEFVTSLQRNEMFVFNMTVEEVNYAILTGYNQLSKNLYRVMKISSKEYWFSHHLETENLVDQESKNLGRSKWCSISSLEGVIKVKVNRLGKIVNIIT

SEQ ID NO: 9800 - protein, 157 aa, unidentified
  REGION 1..157: note = Description of Unknown:uncultivated organism sequence
AIYQDNEGKKHEMVVNFWEAFKRVKAGLPIVIKDVKGLYDAIEEGTITNLPDDLKLPEYDWTFVTSLQRNEYFIFNMKLDEIKLYMAKDYSKISKNLYRVMKLSSKEYWFSHHLETENLVDQESKILGRSKWCSISSLDGAIKVKVNRLGKIVNIIT

SEQ ID NO: 9801 - protein, 170 aa, unidentified
  REGION 1..170: note = Description of Unknown:uncultivated organism sequence
AIYQDAKGQYQESVVSFWQAVERKRYGLPIVIEDPKAIWDKLIDSDLPQEFLSTLPQDDWQFVVSLQSNEMFILGMEDGDFEMAMQNKDYQLLNKYLYRVQKIRGKEYTFRYHVETTVDDKYSNEKGESKPNPALSMQMKKLISIRSFGGWLAQHPHKVRVNLLGEISEV

SEQ ID NO: 9802 - protein, 165 aa, unidentified
  REGION 1..165: note = Description of Unknown:uncultivated organism sequence
AIYQDANGQYQELVVSFWQAVERKRYGLPIVIEDPKAVWDRVMDMDLPQAFLETLPKDNWQFVVSLQANEMFILGLEDGDFEMAMENKDYQLLNKHLYRVQKIGSKDYSFRYHIETSVDDKYDGVHNRALSLTMKKLISIRSFGSWFAQYPHKVRVNLLGEIAEV

SEQ ID NO: 9803 - protein, 170 aa, unidentified
  REGION 1..170: note = Description of Unknown:uncultivated organism sequence
AIYQDKNGQYQESVVSFWQAVERKRYGLPIVIEDPKAEWDKVMDMDLPQEFLETLPKDDWQFVVSLQANEMFILGLEDGDFEMAMENRDYQLLNKHLYRVQKIRGKEYTFRYHIETTVDDKYTNENGEMKPNPALSMQMKKLISIRSFGGWLAQHPHKVRVNLLGEISEA

SEQ ID NO: 9804 - protein, 165 aa, unidentified
  REGION 1..165: note = Description of Unknown:uncultivated organism sequence
ALYKDKEGQMHEQVVTFMQAVMRKQAGLPIVITDPKAVWTGLMDRDDVVDEVLKMLPEDSWTYVVSMQANEMFILGLTDSEFVTAMQEKDYRMLNKHLYRVQKLASSDYYFRYHLETSVDDKYNGEKNEKLSLEMQKVMRVRSFSSLSNLNPIKVRINVLGEISL

SEQ ID NO: 9805 - protein, 159 aa, unidentified
  REGION 1..159: note = Description of Unknown:uncultivated organism sequence
ALYAKPDGTIEERIYTLWQVVERKRYGIPTIIKNPQKVWDDLANTDVDIPEEILNTLPEASSRFLESLQINDMFILGMEEDEYERAIKGKDYTTLGEYLYRVQNLSASQYRFRRHTESKFDTNDMNKADKRFYNIQSLDSLFKLNPHKISINIQGDIMN

SEQ ID NO: 9806 - protein, 165 aa, unidentified
  REGION 1..165: note = Description of Unknown:uncultivated organism sequence
AIYRDKDGKYQESVVSFWDAVERKRYGLPVVIEQPAEVWNKAMDVELPEDMLEKLPKDGWQFVTSMQVNEMFILGMPEADYHEAMLKGDYQALNKYLYRVQKISSKDYYFRYHTETTVDDKYNGTVNPNLSVEMKKMLRLRNISALDAQNPHKVKVNILGEITEL

SEQ ID NO: 9807 - protein, 160 aa, unidentified
  REGION 1..160: note = Description of Unknown:uncultivated organism sequence
AFYLNENGKPVELVCSFYHAIQRRLFNIPTIIENPSELWDLIETSGKEFSEEFLSQLPKPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 9808 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPKPKWTFAFSLQKNEMAIIGSTKNDFEYALQNGDKKTLAQHLYKVQSISPNYYCFTRHTETKYDKNHVNKPDDRFLRYRSVPSLMQDIAAKVSINVIGDILKK

SEQ ID NO: 9809 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIEK

SEQ ID NO: 9810 - protein, 161 aa, unidentified
  REGION 1..161: note = Description of Unknown:uncultivated organism sequence
AFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKND

SEQ ID NO: 9811 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 9812 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEFSEEFLSQLPKPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 9813 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIEK

SEQ ID NO: 9814 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIKK

SEQ ID NO: 9815 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIEK

SEQ ID NO: 9816 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIEK

SEQ ID NO: 9817 - protein, 160 aa, unidentified
  REGION 1..160: note = Description of Unknown:uncultivated organism sequence
AFYLNENGKPVELLCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNSYCFTRHTETKYDKNHVNKPDDRFLRYRSVPSLMQDIAAKVSINVIGDIIKK

SEQ ID NO: 9818 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEFSEEFLSQLPNPKWTFAFSLQKNEMAIIGLTKNDFEYALQNGDKKTIAQHLYKVQSFSHNDYCFTRHTETKYDKNHANKPDERFLRYKSASSLWRDFTAKVSINVIGDIIEK

SEQ ID NO: 9819 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 9820 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 9821 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEFSEEFLSQLPNPKWTFAFSLQRNEMVIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 9822 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 9823 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNSYCFTRHTETKYDKKHTNKADERFMRYASASSLLRDFTAKVSINVIGDIIKK

SEQ ID NO: 9824 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 9825 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNDYCFTRHTETKYDKNHVNKPDDRFLRYRSVPSLMQDIAAKVSINVIGDIIKK

SEQ ID NO: 9826 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEFSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 9827 - protein, 161 aa, unidentified
  REGION 1..161: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISPNYYCFTRHTETKYDKNHVNKPDDRFLRYRSVPSLMQDIAAKVSINVIGDIIKND

SEQ ID NO: 9828 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 9829 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKKHTNKADERFMRYASASSLLRDFTAKVSINVIGDIIKK

SEQ ID NO: 9830 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNGDKKTPAQHLYKVQSISHNSYCSTRHTETKYDKKHTNKADERFMRYASASSLLRDFTAKVSINVIGDIIEK

SEQ ID NO: 9831 - protein, 160 aa, unidentified
  REGION 1..160: note = Description of Unknown:uncultivated organism sequence
AFYLNENGKPVELVCSFYHAIQRRLFNIPTILEKPSEVWDLIETSGKEFSEEFLSQLPNPKWTFAFSLQKNEMAIIGLTKNDFEYALQNGDKKTLAQHLYKVQSISPNYYCFTRHTETKYDKNHVNKPDDRFLRYRSVPSLMQDIAAKVSINVIGDIIKK

SEQ ID NO: 9832 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNDYCFTRHTETKYDKKHTNKADERFMRYASASSLLRDFTAKVSINVIGDIIEK

SEQ ID NO: 9833 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEFSEEFLSQLPNPKWTFAFSLQRNEMVIIGLTKNDFEYALQNDDKKTLAQHLYKVQSISHNSYCFTRHNETKYDKKHTNKDDERFMRYASASSLLRDFTAKVSINVIGDIIEK

SEQ ID NO: 9834 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNDYCFTRHTETKYDKKHTNKADERFMRYASASSLLRDFTAKVSINVIGDIIKK

SEQ ID NO: 9835 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQRNEMVIIGLTKNDFEYALQNDDKKTLAQHLYKVQSISHNSYCFTRHTETKYDKNHVNKPDDRFLRYRSVPSLMQDIAAKVSINVIGDIIKK

SEQ ID NO: 9836 - protein, 160 aa, unidentified
  REGION 1..160: note = Description of Unknown:uncultivated organism sequence
AFYLNENGKPVELVCSFYHAIQRRLFNIPTIIENPSEVWDLIETSGKEYSEEFLSQLPNPKWTFAFSLQKNEMAIIGLTKNDFEYALQNGDKKTLAQHLYKVQSISHNDYCFTRHTETKYDKNHANKPDERFLRYKSASSLLRDFTAKVSINVIGDIIEK

SEQ ID NO: 9837 - protein, 160 aa, unidentified
  REGION 1..160: note = Description of Unknown:uncultivated organism sequence
AFYLNENGKPVELVCSFYHAIQRRLFNIPTIIEKPSEVWDLIETSGKEFSEEFLSQLPNPKWTFAFSLQKNEMAIIGLTKNDFEYALQNDDKKTLAQHLYKVQSISPNYYCFTRHTETKYDKNHVNKPDDRFLRYRSVPSLMQDIAAKVSINVIGDIIKK

SEQ ID NO: 9838 - protein, 170 aa, unidentified
  REGION 1..170: note = Description of Unknown:uncultivated organism sequence
AIYVDEKGEPKECIYTFWQMVERSKYKLPLIIKNPKTLWEEILQREKDGEKFPDSLIQSLPPSNWTFIESLQLNDMFIMDMDNDDYNRNIDTNNYEELSKKLYRIQNISSGDYFLRLHTDTTTDRNNAKLTKKFLRKSLTGFLSSNPHKVQISLLGKIIRNSNDQKDPMF

SEQ ID NO: 9839 - protein, 160 aa, unidentified
  REGION 1..160: note = Description of Unknown:uncultivated organism sequence
AIYADEKREYKECIYTFWQAVERSKYRLPLIIKDPKVVWEEIYKRENDGETFPDSLIQSLPLPNWTFVESLQLNDMFIMDMDDDDFERNIVTNNYEELGKKLYRIQTISTGDYFLRLHTDTTTDRINSKLTKKFLRKSLMSFVSSNPHKVQISLLGKIIR

SEQ ID NO: 9840 - protein, 157 aa, unidentified
  REGION 1..157: note = Description of Unknown:uncultivated organism sequence
ALYRDASGNLSEHVVSFWNAVERKKYGIPVIIEDTAVLWNQMAKKNLPEHFLNSLPPAGLKLETSLQQNEMFILGMPEEDYQRAIREKDYKQLNKYLYRVQKIATQDYYFRFHVETVLDDSAEALSSKKYYRTRIGAFMKLNPHKVLVNLLGEIAEL

SEQ ID NO: 9841 - protein, 165 aa, unidentified
  REGION 1..165: note = Description of Unknown:uncultivated organism sequence
AIYMDSNGQYQESVVSFWQAVERKRYGLPIVIEDPKAVWDKVMNLDLPQEFLQTLPNDDWQFVVSLQSNEMFILGIEDGDFELAMENQDYQLLNKHLYRVQKIATKNYAFRHHIETSVDDKYDGVKKEMLSKQMQKLKITQSFDSFFALHPHKVRVNLLGEITNV

SEQ ID NO: 9842 - protein, 158 aa, unidentified
  REGION 1..158: note = Description of Unknown:uncultivated organism sequence
AIYKDENGILQESVVTFWHAVERKKYGLPIVISNPKEAWKIAREKNCSKDFLECLPNENWIFEQSLQQNEMFVLGLSADDYEKALKEKDYALLNQHLYRVQKISSSNYMFRHHLETQIDDSVAAKEIGKFKNIQSFKALLQVNPQKVRISLLGKLICI

SEQ ID NO: 9843 - protein, 140 aa, unidentified
  REGION 1..140: note = Description of Unknown:uncultivated organism sequence
DVFSKKGQFHLVPIYKHQLIERTPPMRAIVAAKPDSDWTLIDSTFRFEFSLWKNSRFEFKHKKNGFIDGCYDSVNRSTGRIDYSRPDDGTCEKDDKGRDIKFGFSTLTGVVFFRKISVDRLGRKFLVKSEKRTWRGAVCI

SEQ ID NO: 9844 - protein, 135 aa, unidentified
  REGION 1..135: note = Description of Unknown:uncultivated organism sequence
DIFSKPNKRRNKEYFIVPVYTYHISDESPPNKAITAHKNENDWVEIGSNFQFEFSLWPNSRVRIKKKDGPSLIGLYETVDRSGGTLSLCDPSDPKLKTRCSIKQGTTLFQKWTMDRLGREYHVPKEQRTWRGSNV

SEQ ID NO: 9845 - protein, 135 aa, unidentified
  REGION 1..135: note = Description of Unknown:uncultivated organism sequence
DIFSKPNKRRNKEYFIVPVHTYHISDESPPNKAITAHKNENDWVEIGSNFQFEFSLWPNSRVRIKKKDGPSLIGLYETVDRSGGTLSPCDPSDPKLKTRCSIKQGPTHIKKWTMDRLGREYHVPKEQRTWRGSNV

SEQ ID NO: 9846 - protein, 135 aa, unidentified
  REGION 1..135: note = Description of Unknown:uncultivated organism sequence
DVFSKGGKYALIPVYSHQLSCTEPPMKFISANKPESEWKSVDETYQFEFSLWKNSRFQVNEKVKKGAASVVVGCYAGLHRGTGKITYNLPNDHGADSFFVSPMTSLKFQKLQIDRLGRVFPIPKEKRTWRGKVCI

SEQ ID NO: 9847 - protein, 137 aa, unidentified
  REGION 1..137: note = Description of Unknown:uncultivated organism sequence
DVFSKGGKYALIPVYSHQLSSTEPPMKFIGANKPESDWKAIDETYQFEFSLWKNSRFQVNEKPKNGAAVGQIVTGCYASLHRVLGQITYNMPDDHGADSLVIAPMTSLKFQKLQIDRLGRVFSIPKEKRTWRGKVCI

SEQ ID NO: 9848 - protein, 137 aa, unidentified
  REGION 1..137: note = Description of Unknown:uncultivated organism sequence
DVFSKNGKYALVPVYSHQLSQDAPPTRYIKANKPESEWLELDATFQFEFSLWRNSRFRVTEKAKRGNAVGNLIEGNYTSLHRGTGLVSYNLPDDHGADPLGVSPVTSIKFEKLYVDRLGRVYPVPKEKRTWRGKVCI

SEQ ID NO: 9849 - protein, 102 aa, unidentified
  REGION 1..102: note = Description of Unknown:uncultivated organism sequence
DVFRKAGKFYLVPIYAWQVATMDRPPDRAIVSAAPEDRWPVVDGSYEFLWSLHPDSSFAPRTVRAKSSRAISARSTGATAGSVFHHTGPGTARRSSGSPRRR

SEQ ID NO: 9850 - protein, 133 aa, unidentified
  REGION 1..133: note = Description of Unknown:uncultivated organism sequence
DVFTKGGRFYLVPVYAWQLAALASAPSRAIRNLADEKDWYQIDGTFAFLWSIHPGSYLKAVAADGSKFEGYFRSLDRSNGRVSFSPASNGDSKAQRRFKTMTLKSFEKYHVDRLGRLHRIDKEPRLWHGAVCS

SEQ ID NO: 9851 - protein, 131 aa, unidentified
  REGION 1..131: note = Description of Unknown:uncultivated organism sequence
DVFTKAGRFYLVPVYAWQVAQLDGPPMRAIVAHKDEVDWTPMDQSFAFVFTIYPGSYIRATNRSGELFEGYYSATDRSSATLALQPATGVGKPARPGTKLLASFEKYHVDRLGRLHRVEKEPRMWHGVVCS

SEQ ID NO: 9852 - protein, 133 aa, unidentified
  REGION 1..133: note = Description of Unknown:uncultivated organism sequence
DVFRKAGKFYLVPIYAWQVATMDRPPDRAIVSAAPEDRWPVVDGSYEFLWSLHPGSFVRAENREGQIFEGYFRSLDRSNGRISFSPHWTGDSKAQLRFTTKTLKSFEKYHVDRLGRRYRVEREPRMWHGVVCS

SEQ ID NO: 9853 - protein, 141 aa, unidentified
  REGION 1..141: note = Description of Unknown:uncultivated organism sequence
DVFSKKGQFHLVPIYKHQLIERTPPMRAIVAAKLDDNDWTLIDSTFHFEFSLWTNSRFELIYTDGEKIEGCYRGVSRNTAVIAYFPPDRFGEQKDENGKNPYPPVSCKTGVSTFRKINVDRLGRSFFVKGEKRTWRGAVCI

SEQ ID NO: 9854 - protein, 137 aa, unidentified
  REGION 1..137: note = Description of Unknown:uncultivated organism sequence
DVFSKKGKYALIPIYSHNLAQNTPPMRFIKANKPESEWTEVDETYSFEFSLWRNSRFRVTSKPKGSLGTGEVKEGNYVSLHRGTGKITYNLPDDHGADSQHVSPVTSLKFEKLYVDRLGRVFPIPREKRTWRGKVCT

SEQ ID NO: 9855 - protein, 140 aa, unidentified
  REGION 1..140: note = Description of Unknown:uncultivated organism sequence
DVFSRKGKYHLVPVYAHQLAGRTPPMHAIVAHKPESEWTLVDESFRFEFSLWKNSRFEIRFKTGRVIEGDYSGVNRSDGGITYNPPDDASTRKSGDGRPVNYKFATKTGVVSFRKISVDRLGRAFPVKGEKRTWRGAVCI

SEQ ID NO: 9856 - protein, 123 aa, unidentified
  REGION 1..123: note = Description of Unknown:uncultivated organism sequence
DVFTKDGKYYLIPVYTSQIARGEAPNRAVVANKPESEWTLIDDTFSYLFSMTPNSYIVTEDRKGLIREGYFTSTDRTTAAITLRQANDHTKEIRSGTKTLKLFQKYRVDRLGRLYRVRKEVRP

SEQ ID NO: 9857 - protein, 134 aa, unidentified
  REGION 1..134: note = Description of Unknown:uncultivated organism sequence
SRYLEKCKGRKEPLPIRPAYDKLTPEENLQLYDAFTQWLTSGIYAKRLSLQGKFLLEKRDAFAALSPEAQVRQLMEILHLFQCNPVAANLSELGGAAHAGILLASKNIDGKVPVSIVHQSVTGYFTQEVCLNDL

SEQ ID NO: 9858 - protein, 151 aa, unidentified
  REGION 1..151: note = Description of Unknown:uncultivated organism sequence
LKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQKVDLMKL

SEQ ID NO: 9859 - protein, 151 aa, unidentified
  REGION 1..151: note = Description of Unknown:uncultivated organism sequence
FKYESDLAINEEIIDDKNAAEENKQKAHEKLGFYENTWGISEASNMRLYDILIAKSANNFYKNRPASQTSVLKQQRDKFAKLPLSKQIRVINEAINLFKCASATADFKLLEKGSACGKIQVSTNITKCKQCILINQSPTGVFEQEVDLMKL

SEQ ID NO: 9860 - protein, 151 aa, unidentified
  REGION 1..151: note = Description of Unknown:uncultivated organism sequence
LKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 9861 - protein, 151 aa, unidentified
  REGION 1..151: note = Description of Unknown:uncultivated organism sequence
LKYRDSIEENENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 9862 - protein, 151 aa, unidentified
  REGION 1..151: note = Description of Unknown:uncultivated organism sequence
LKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGTSCGVIKTSNNITKCEQCILINQSPTGVFEQEVDLMKL

SEQ ID NO: 9863 - protein, 151 aa, unidentified
  REGION 1..151: note = Description of Unknown:uncultivated organism sequence
LMYETNIAEKEKTLADQNADDIQKEKAQKGLDFYEQKWGISGAVNVQLYDMFIAKSANNLYKNRPVSQTITLKEKREHFVKLTVSKQIHIIKEILNLFKCASASDDFKLIDKGTSCGTLKISNNINKLKECILINQSPTGVFEQEVDLMKL

SEQ ID NO: 9864 - protein, 151 aa, unidentified
  REGION 1..151: note = Description of Unknown:uncultivated organism sequence
LKYESNLEENEAILADKNADESMKQKAFNRLEFYKNTWEISAVANLQIYDMLLAKSANNLYKNRPASQTATLKEKREQFAKLSLSKQIHVIKEILNLFKCASASADFKLLDKGTSCGTLKVSNNITKLKQCVLINQSPTGVFEQEVDLMKL

SEQ ID NO: 9865 - protein, 151 aa, unidentified
  REGION 1..151: note = Description of Unknown:uncultivated organism sequence
LKYENDIAENELVIADKNSDDIQKQQAQKNLDYYNQKWRIGRKVNMHIYDMLLAKSGNNLYKNRPASQTTDLQEHREFFEKLSLANQIHVIGEVLKLFKCASASANLKLLDKGNACGVIKVSNNILKFKQCVLINQSPTGVFEQEVDLMKL

SEQ ID NO: 9866 - protein, 151 aa, unidentified
  REGION 1..151: note = Description of Unknown:uncultivated organism sequence
LKYEVYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 9867 - protein, 151 aa, unidentified
  REGION 1..151: note = Description of Unknown:uncultivated organism sequence
LKYRDSIEKNENIITAKDTDDKQKEKAQKRLDFYKQTWGISREANMRIYDILLAKSGNNLYKNRPASQTKDLQEQRGTFEKLPLSKQIYVIGEFLNLFKCASTSADFKLLGKGNSCGVIKTTNNVTKCKQCVLINQSPTGVFEQEVDLMKL

SEQ ID NO: 9868 - protein, 151 aa, unidentified
  REGION 1..151: note = Description of Unknown:uncultivated organism sequence
FKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISSVKQCILINQSPTGIFEQEVDLMKL

SEQ ID NO: 9869 - protein, 103 aa, unidentified
  REGION 1..103: note = Description of Unknown:uncultivated organism sequence
LKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASA

SEQ ID NO: 9870 - protein, 151 aa, unidentified
  REGION 1..151: note = Description of Unknown:uncultivated organism sequence
LKYEADIAENELVIADTNADDIQKQNAQKRLDYYNQKWRIGRKINMHIYDMLLAKSGNSLYKNRPASQTTDLQEQRDVFEKLSLADQIHVIGEVLKLFKCASASANLKLLDKGNACGVIKVSNNILKFKQCILINQSPTGVFEQEVDLMKL

SEQ ID NO: 9871 - protein, 151 aa, unidentified
  REGION 1..151: note = Description of Unknown:uncultivated organism sequence
LMYETNIAEKEKTLADQNADDIQKQKAQKGLDFYEQKRGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 9872 - protein, 151 aa, unidentified
  REGION 1..151: note = Description of Unknown:uncultivated organism sequence
LKYESNLEENEAILADKNADESMKQKAFNRLMFYKDTWGISAEANLQLYDMLLAKSANNLYKNRPASQTATLKEKREQFAKLSLSKQIHVIKEILNLFKCASASADFKLLDKGAACGILKVSNNITKLKQCVLINQSPTGVFEQEVDLMRL

SEQ ID NO: 9873 - protein, 151 aa, unidentified
  REGION 1..151: note = Description of Unknown:uncultivated organism sequence
LKYENDIAENELVIADKNSDDIQKQQAQKKLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 9874 - protein, 135 aa, unidentified
  REGION 1..135: note = Description of Unknown:uncultivated organism sequence
FKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNILQVFLNRKWI

SEQ ID NO: 9875 - protein, 151 aa, unidentified
  REGION 1..151: note = Description of Unknown:uncultivated organism sequence
LKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCEKCILINQSPTGVFEQEVDLMKL

SEQ ID NO: 9876 - protein, 151 aa, unidentified
  REGION 1..151: note = Description of Unknown:uncultivated organism sequence
LKYETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 9877 - protein, 151 aa, unidentified
  REGION 1..151: note = Description of Unknown:uncultivated organism sequence
LMYETNIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 9878 - protein, 151 aa, unidentified
  REGION 1..151: note = Description of Unknown:uncultivated organism sequence
LKYETDIAEKEKTLADQNADDIHKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 9879 - protein, 151 aa, unidentified
  REGION 1..151: note = Description of Unknown:uncultivated organism sequence
LKYENDIAENELVIADKNSDDIQKQQAQKNLDYYNQKWRISRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 9880 - protein, 151 aa, unidentified
  REGION 1..151: note = Description of Unknown:uncultivated organism sequence
LKYENDIAENELVIADKNSDDIQKQQAQKNLDYYNQKWRIGRKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEHEVDLMKL

SEQ ID NO: 9881 - protein, 151 aa, unidentified
  REGION 1..151: note = Description of Unknown:uncultivated organism sequence
FKYENNLAVNDEIIADKNADEEKKQKARKRLDFYEKTWGIGKENNIRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 9882 - protein, 151 aa, unidentified
  REGION 1..151: note = Description of Unknown:uncultivated organism sequence
LKYETDIAEKEKTLADQNADEIQKQKAQKGLDFCEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 9883 - protein, 151 aa, unidentified
  REGION 1..151: note = Description of Unknown:uncultivated organism sequence
FKYESDLAINEEIIDDKNAAEENKQKAHKRLDFYENTWGISEVANMQLYDILIAKSANNLYKNRPASQTSTLKQQRDMFAKLPLSKQIRVIKEAMNLFKCASATADFKLLGKGSVCGKIQVSTNITKCKQCILINQSPTGVFEQEVDLMKL

SEQ ID NO: 9884 - protein, 151 aa, unidentified
  REGION 1..151: note = Description of Unknown:uncultivated organism sequence
FKYENNLAVNDEIIADKNADEEKKQKARKRLDFYEKTWGIGKENNMRIYDILLAKSANNLYKKRPASQSATLEKRRENFKGLFVSKQIHVLKEILNLFKCLSATADLQLLGAGKNVGKVTWNTNISNVKQCILINQSPTGIFEQEVDLMKL

SEQ ID NO: 9885 - protein, 151 aa, unidentified
  REGION 1..151: note = Description of Unknown:uncultivated organism sequence
LKYEAYIALNEGLISDKNADDTQKQKAQQRLDYFKQKWGISSDANMKIYDILLAKSANNLYKNRPASQTKDLQEQRCVFEKLSLAEQIHIIGEVLNLFKCASASANLKLLGKGNSCGVIKTSNNITKCKQCILINQSPTGVFEQEVDLMKL

SEQ ID NO: 9886 - protein, 151 aa, unidentified
  REGION 1..151: note = Description of Unknown:uncultivated organism sequence
LMYETDIAEKEKTLADQNADDIQKQKAQKGLDFYEQKWGISGAVNVQLYDMFIAKSANNLYKNRPVSQTITLKEKREHFVKLTVSKQIHIIKEILNLFKCASASADFKLIDKGTSCGTLKISNNINKLKECILINQSPTGVFEQEVDLMKL

SEQ ID NO: 9887 - protein, 151 aa, unidentified
  REGION 1..151: note = Description of Unknown:uncultivated organism sequence
FKYESDLAVNEEILADENGDEVRKQKARNRLAFYDNTWGISLEANMQLYDMLLAKSANNLYKNRPASQTSTLKEQREQFSILPLSKQIHVIKEILKLFKCASATADFKLLEKGSTCGKIQVSTNITKCKQCILINQSPTGVFEQEVDLMKL

SEQ ID NO: 9888 - protein, 151 aa, unidentified
  REGION 1..151: note = Description of Unknown:uncultivated organism sequence
LKYETDIAEKEKTLADQNADEIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 9889 - protein, 134 aa, unidentified
  REGION 1..134: note = Description of Unknown:uncultivated organism sequence
SRYLEKCKGRKEPLPIRPAYDKLTPEENLQLYDAFTQWLTSGIYAKRLFLQGKFLLEKRDVFAALNPEAQVRQLMEILHLFQCNPVAANLSELGGAAHAGILLASKNIDGKVPVSIVHQSVTGYFSQEVCLNDL

SEQ ID NO: 9890 - protein, 134 aa, unidentified
  REGION 1..134: note = Description of Unknown:uncultivated organism sequence
SRYLEKCKGRKEPLPIRPAYDKLTPEENLQLYDAFTQWLTSGIYAKRLSLQGKFLLEKRDAFAALSPEAQVRQLMEILHLFQCNPVAANLSELGGVAHAGILLASKNIDGKVPVSIVHQSVTGYFVQEVCLNDL

SEQ ID NO: 9891 - protein, 151 aa, unidentified
  REGION 1..151: note = Description of Unknown:uncultivated organism sequence
LKYENDIAENELVIADKNSDDIQKQQAQKNLDDYNQKWRIGRKVNMHIYDMLLAKSGNNLYKNRPASQTTDLQEQRELFEKLSLANQIHVIGEVLKLFKCASASANLKLLDKGNACGVIKVSNNILKFKQCVLINQSPTGVFEQEVDLMKL

SEQ ID NO: 9892 - protein, 144 aa, unidentified
  REGION 1..144: note = Description of Unknown:uncultivated organism sequence
DVFHVDGDGYYFVPIYTSDTVKPELPNRAVVAGRRVQEWKVMDDSYFKFSLYPKDLIRIRSKKGIKLKAVNRNADLQEYSTNDCLCYFVKFNISTGALSVENHDRKFEQPGLGGKTLLSIEKYQVDVLGNYSPVALPEKRMKFR

SEQ ID NO: 9893 - protein, 154 aa, unidentified
  REGION 1..154: note = Description of Unknown:uncultivated organism sequence
DVFHIKEGKDKGYYFIPIYVADTIKQKLPQKAVVAAKSIDQWKEMDDEDFIFSLYPGDLVRVEHKKDIVFKSTDKNSSDTISCKNLLTYYSGANISTGAITITNHDRSYIVHGLGIKTLQLLEKYEVDVLGNYHKVRLPEKRQAFNLKYSQKKQ

SEQ ID NO: 9894 - protein, 146 aa, unidentified
  REGION 1..146: note = Description of Unknown:uncultivated organism sequence
DIFYVENEGYYFIPIYVSDTVKKELPNKACVAGKKYADWKEMKEKDFIFSIYPKDLLYIQGKNKIKLNPVVKDKDPIEVEEILAYYLKIDISTATIEIKSNENKYVKRGLGGKGLKKLEKYEVDILGNYHKVKLPEKRLPFNINKK

SEQ ID NO: 9895 - protein, 146 aa, unidentified
  REGION 1..146: note = Description of Unknown:uncultivated organism sequence
DVFYVENEGYYFIPIYVSDTVKKELPNKACVAGKKYADWKEMKDEDFIFSIYPKDLIYIQGKNKIKLNPVIKDKEPIEVEEIFAYYVKAGISSAAITIQTNDSKYVQPSLGIKSLKKLEKYEVDILGNYHKVKLPEKRLPFNINKK

SEQ ID NO: 9896 - protein, 145 aa, unidentified
  REGION 1..145: note = Description of Unknown:uncultivated organism sequence
DIFYVEGEGYYFVPIYVSDTIKEKLPNKACVQGKKYEEWKEMREEDFIFSLYPKDLIYVKGKNKIKLNATNKSGEQIEVEDTMAYYINAGISVAQITIQTHDNKYEQPSLGIKSLKELKKYEVDVLGNYHEVKIPEKRMPFNIKK

SEQ ID NO: 9897 - protein, 145 aa, unidentified
  REGION 1..145: note = Description of Unknown:uncultivated organism sequence
DVFYVEGEGYYFIPIYVADTIKKELPNKACVANKGTDKWKTMDDKNFIFSLYPNDLIYIESEKGIKLNGNNDNKKEQIEVKKLFAYYVKAGISTAAITIDNQDGEYTQPGLGIKGLKKIEKYDIDVLGNYHKIKLPEKRIKFNIN

SEQ ID NO: 9898 - protein, 145 aa, unidentified
  REGION 1..145: note = Description of Unknown:uncultivated organism sequence
DVFYIEGDGYYFIPIYVSDTIKKELPNRACVPNKTYSEWKEMDEKNFIFSLYPKDLLYIKGKNKIKLNPTNKIDEPIEVEETMAYYVKAGISVASITIQTHDNKYQQPNLGIKTLKKLKKYEVDVLGNYHEVKLPEKRMPFNIKK

SEQ ID NO: 9899 - protein, 153 aa, unidentified
  REGION 1..153: note = Description of Unknown:uncultivated organism sequence
DVFYVKGEGYYFIPIYVADTIKKELPQKAVVDKSVAVKHGWKEMNDKDFIFSLYPGDLIRVEHKSQIVLKSTQKNSKDTKVGKEFFLYYKSANISNGAIDASYHDQSYEKEGLGIKTLQSFEKYEVDVLGNYHKVHLPEKRQAFNLKYSQKEQ

SEQ ID NO: 9900 - protein, 147 aa, unidentified
  REGION 1..147: note = Description of Unknown:uncultivated organism sequence
DVFYVEDEGYYFVPIYVADTKKECLPNKAVVAYKAYSDWKEMTDENFIFSLYPGDLVRIQSRKGIKLNIAKGGTGEKEIVRQDGMYYYQTANISSGAITISTHDRRYSQPSLGIKTLQSIEKYQVDVLGNYYKVDLPEKRMSFSEEG

SEQ ID NO: 9901 - protein, 147 aa, unidentified
  REGION 1..147: note = Description of Unknown:uncultivated organism sequence
DVFRVPDDGYYFVPIYVADTKKAVLPSKAVVAGKSPEAWKQMKPERFLFSLFKDDLIYVESRKGISLALAKEAVGEKTIQPKSGLFYFCGANISSGSIGIETDDRRYGKESLGLKTLTLIEKCQVDVLGNVSKVRLPEKRLEFRGRK

SEQ ID NO: 9902 - protein, 147 aa, unidentified
  REGION 1..147: note = Description of Unknown:uncultivated organism sequence
DVFYVEDDGYYFVPIYVADTKKESLPNKAVVAYKAYSEWKEMKDENFIFSLYPGDLVRIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 9903 - protein, 145 aa, unidentified
  REGION 1..145: note = Description of Unknown:uncultivated organism sequence
DVFYMEDDGYYYVPIYTADVIKGKLPNKAVVQGKTFEDWKEMDDRDFLFSMYPSDLLYIESRRGIKLKTKKGSSWQEEIARKAGLYYFKGLNISSGNLFIITHDHSYEQSSLGGKTLSCLKKYTVDALGNYSEVSLPEKRKPLRG

SEQ ID NO: 9904 - protein, 147 aa, unidentified
  REGION 1..147: note = Description of Unknown:uncultivated organism sequence
DVFYVEDDGYYFVPIYVADTKREKLPNKAAVAMKPYNLWKEMKDENFVFSLYPGDLVRIQSRKGIKLNLAKGGTGEKEIVRQDGMYYYRSAGIAVAQIFVETHDRRYLQPSLGIKTLQSIEKYQVDVLGNYQKVDLPEKRMTFSKEG

SEQ ID NO: 9905 - protein, 147 aa, unidentified
  REGION 1..147: note = Description of Unknown:uncultivated organism sequence
DVFYVEDDGYYFVPIYVADTKKERLPNKAVVAYKAYSEWKEMKDENFIFSLYPGDLVRIQSRKGIKLTLTKGGTGEPEIVRQQGMYYYQTANISSGAVTISTHDRRYSQSSLGIKTLQSIEKYQVDVLGNYYKVDLPEKRMTFSKEG

SEQ ID NO: 9906 - protein, 145 aa, unidentified
  REGION 1..145: note = Description of Unknown:uncultivated organism sequence
DVFYIEDDGYYYVPIYTADVIKGALPNRAVVADKSHGEWKVMNDKDFLFSMYPNDLLYIESRKGIKLKTKKGSSKQEQIVRKTGLYYFKGLNISSNALSIITHDHSYEQSSLGGKTLSCLKKYTVDALGNYSEVSLPEKRKPLRG

SEQ ID NO: 9907 - protein, 152 aa, unidentified
  REGION 1..152: note = Description of Unknown:uncultivated organism sequence
DVFKVEGEGYYFVPIYVSDTIKNKLPNKASVASKPYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 9908 - protein, 147 aa, unidentified
  REGION 1..147: note = Description of Unknown:uncultivated organism sequence
DVFYVEDDGYYFVPIYVADTKKAELPNKAVVAYKAYSDWKEMIDENFLFSLYPGDLVRIQSRKGIKLNIAKGGTGEKEIVRQDGLYYYQGANIATGAIALATHDRRYLQSGLGLKTLQSIEKYQVDVLGNYYKVDLPEKRMKFSKEG

SEQ ID NO: 9909 - protein, 147 aa, unidentified
  REGION 1..147: note = Description of Unknown:uncultivated organism sequence
DVFRIPDDGYYFVPIYVADTKKATLPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 9910 - protein, 145 aa, unidentified
  REGION 1..145: note = Description of Unknown:uncultivated organism sequence
DVFYMEDDGYYYVPIYITDVVKDELPNKAVVQKKLPEDWKEMDDRDFLFSMYPNDLIYVERKEVFELTAPKGSSLDPTISKTKGFFYYRSFDSNTGSFKIYTHDSSYSKKSLGGKTLSCLKKYTVDVLGNYSEVSLPEKRKPLRG

SEQ ID NO: 9911 - protein, 147 aa, unidentified
  REGION 1..147: note = Description of Unknown:uncultivated organism sequence
DIFYVEDDGYYFVPIYVADTKKDRLPSKAPVAHKAYSAWKEMRNENFIFSLYPGDLVRIQSRAGIKLSLAKDGTGEKEIVRQNGLYYYRSADIEGGKIDIEAHDRRYSKHGLGLKTLQSIEKYQVDVLGNYYKVDLPEKRMTFSKEG

SEQ ID NO: 9912 - protein, 147 aa, unidentified
  REGION 1..147: note = Description of Unknown:uncultivated organism sequence
DVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPEKRMTFSEEG

SEQ ID NO: 9913 - protein, 140 aa, unidentified
  REGION 1..140: note = Description of Unknown:uncultivated organism sequence
DVFRVPNERKPDDSYYFVPIYVADTKKGILPWKQMKPEHFLFSIFKGDLIYVESKKEISLALAKEAVGEKTIQVKSGLFYFCGANISNGSIEIETHDRRYGKEGLGIKKLKVFEKRQVEVLGEVKKVKLPEKRLEFRGRK

SEQ ID NO: 9914 - protein, 147 aa, unidentified
  REGION 1..147: note = Description of Unknown:uncultivated organism sequence
DVFHVPDDGYYFVPIYVADTKKAALPSKAVVAHKLPEAWKQMKPEHFLFSLFKGDLIQLENRKGISLLLTKEAIGEKTIQVKSGLFYFCGADISNGSIEIETHDRRYGKKSLGLKTLTAIEKYQVDVLGNVNKVKLPEKRLEFRGRK

SEQ ID NO: 9915 - protein, 152 aa, unidentified
  REGION 1..152: note = Description of Unknown:uncultivated organism sequence
DVFKVEGEGYYFVPIYVSDTIKNKLPNKASVASKTYAEWKEMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 9916 - protein, 145 aa, unidentified
  REGION 1..145: note = Description of Unknown:uncultivated organism sequence
DVFYIEGDGYYYVPIYITDVVKDELPNRAVVTQKSHGEWKVMDDKDFLFSMYPHDLIYVERKEAFTLDAPKNSSLDPTISKTKGFFYYRSFDSGTGSFKIYTHDRSYSKKSLGGKTLSCLKKYTVDVLGNYSEVSLPEKRKPLRG

SEQ ID NO: 9917 - protein, 147 aa, unidentified
  REGION 1..147: note = Description of Unknown:uncultivated organism sequence
DVFYVEDDGYYFVPIYVADTKKESLPNKAVVAYKAYSEWKEMKDENFIFSLYPRDLVCIQSRKGIKLNLAKGGTGEKEIVRQEGMYYYRAAGITVGAIQIETHDRRYLQPSLGIKTLQSIEKYQVDVLGNYYKVDLPEKRMTFSKEG

SEQ ID NO: 9918 - protein, 144 aa, unidentified
  REGION 1..144: note = Description of Unknown:uncultivated organism sequence
DVFYVDGDGYYFVPIYTADIVKPKLPNRAVVAGKKASEWKMIDDNHFVFSLYPKDLLRIRSNKGIKLKAVNKNADLQEYSANDCLCYYVGFDIATGAFTVESHDRRLNRRGLGGKTLLSIEKYQVDVLGNYFPVALPEKRMKFR

SEQ ID NO: 9919 - protein, 147 aa, unidentified
  REGION 1..147: note = Description of Unknown:uncultivated organism sequence
DVFYVEDDGYYFVPIYVADTKKAELPNKAVVAYKAYSDWKEMIDENFLFSLYPGDLVRIQSRKGIKLNIAKGGTGEKEIVRQDGMYYYQGANIATGAIALATHDRRYLQSGLGLKTLQSIEKYQVDVLGNYYKVDLPEKRMKFSEEG

SEQ ID NO: 9920 - protein, 145 aa, unidentified
  REGION 1..145: note = Description of Unknown:uncultivated organism sequence
DVFYIEGDGYYYVPIYITDVVKDELPNRAVVTQKSHGEWKVMDDKDFLFSMYPHDLIYVERKEAFTLDALKNSSLDPTISKTKGFFYYRSFDSGTGSFKIYTHDSSYSKKSLGGKTLSCLKKYTVDILGNYSEVSLPEKRKPLRG

SEQ ID NO: 9921 - protein, 145 aa, unidentified
  REGION 1..145: note = Description of Unknown:uncultivated organism sequence
DVFYVEDDGYYYVPIYTADVIKGALPNRAVVAHKSHGEWKVMDDKDFLFSMYPNELLYIESRKGIKLKTKKGSSRQEEIIRKAGLYYFKWLNIAANALFIITHDNGYEQPSLGGKTLSCLKKYTVDALGNYSEVSLPEKRKPLRG

SEQ ID NO: 9922 - protein, 145 aa, unidentified
  REGION 1..145: note = Description of Unknown:uncultivated organism sequence
DVFYIEDDGYYYVPIYITDVVKDELPNKAVVQKKLPKDWKEMDDRDFLFSMYPNELLYIESRKGIKLKTKKGSSRQEEIIRKAGLYYFKRLDIASGNLFIITHDHSYEQPSLGGKTLSCLKKYTIDVLGNYSEVSLPEKRKPLRG

SEQ ID NO: 9923 - protein, 152 aa, unidentified
  REGION 1..152: note = Description of Unknown:uncultivated organism sequence
DVFKVEGEGYYFVPIYVSDTIKNKLPNKASVASKLYAEWKEMQDKDFIFSLYPRDLFYVKSKNKIKLTSINKQDKESLETNELFAYYVKAGISTAAIACINHNGEYEQNSLGIKRLQEFKKYEVDVLGNYHEVKLPEKRQDFSNLKKGGSLK

SEQ ID NO: 9924 - protein, 153 aa, unidentified
  REGION 1..153: note = Description of Unknown:uncultivated organism sequence
DVFKVDGEGYYFVPIYVSDTIKSKLPNKACVAAKQYSEWKDMKDENFIFSLYPRDLIYIKSKNKIKLTSINKENKETKEISEMFAYYIKSGISTAAISIINHNGEYEQNSLGIKTLKEFKKFEVDVLGNYHEVKLPEKRQSFKNLKKKGGSLK

SEQ ID NO: 9925 - protein, 147 aa, unidentified
  REGION 1..147: note = Description of Unknown:uncultivated organism sequence
DVFYVEDDGYYFVPIYVADTKKERLPNKAVVAYKAYSEWKEMKDENFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 9926 - protein, 147 aa, unidentified
  REGION 1..147: note = Description of Unknown:uncultivated organism sequence
DVFYVEGDGYYFVPIYVADTKKESLPNKAAVAMKPYNLWKKMKDENFVFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 9927 - protein, 147 aa, unidentified
  REGION 1..147: note = Description of Unknown:uncultivated organism sequence
DVFYVEDDGYYFVPIYVADTKKESLPNKAAVAMKPYNLWKEMNDENFAFSLYPGDLVRIQSRKGIKLNLAKGGTGEKEIVRQEGMYYYRSAGIAVAQISVETHDRRYLQPSLGIKTLQSIEKYQVDVLGNYYKVDLPEKRMTFSKEG

SEQ ID NO: 9928 - protein, 153 aa, unidentified
  REGION 1..153: note = Description of Unknown:uncultivated organism sequence
DVFKVDGEGYYFVPIYVSDTIKSKLPNKACVAAKQYSEWKDMKDENFIFSLYPRDLIYIKSKNKIKLTSINKENKENKEISEMFAYYIKSGISTATISIINHNGEYEQNSLGIKTLKEFKKFEVDVLGNYHEVKLPEKRQSFKNLKKKGGSLK

SEQ ID NO: 9929 - protein, 147 aa, unidentified
  REGION 1..147: note = Description of Unknown:uncultivated organism sequence
DVFYVEDDGYYFVPIYVADTKKESLPNKAVVAYKAYSEWKEMKDENFIFSLYPGDLVCIQSRKGIKLNLAKGGTGEKEIVRQEGMYYYRAAGITVGAIQIETHDRRYLQPSLGIKTLQSIEKYQVDVLGNYQKVDLPEKRMTFSKEG

SEQ ID NO: 9930 - protein, 147 aa, unidentified
  REGION 1..147: note = Description of Unknown:uncultivated organism sequence
DVFREEDDGYYFVPIYVADTKKERLPNKAVVAYRPYEDWKEMQDENFVCSLYPGDLVRIQSRKGIKLNLAKGGTGEREIVRQDGLFYYRGADIAGGKIKIETHDRRYSQPSLGVKTLRSIEKYQVDVLGNYYKVKLPENRMTFSKEG

SEQ ID NO: 9931 - protein, 145 aa, unidentified
  REGION 1..145: note = Description of Unknown:uncultivated organism sequence
DVFYMEDDGYYYVPIYTADVIKGVLPNKAVVRNKLPEDWKEMDDRDFLFSMYPNDLLYIESRRGIKLKTKKGSSRQEEIVRKTGLYYFKGLNIATNALFIITHDNGYEQPSLGGKTLSCLKKYTVDALGNYSEVSLPEKRKPLRG

SEQ ID NO: 9932 - protein, 147 aa, unidentified
  REGION 1..147: note = Description of Unknown:uncultivated organism sequence
DVFYVEDDGYYFVPIYVVDTKKENLPNKAVVAYKAYSDWKEMRDEDFVFSLYPGDLVCIQSRKGIKLNLAKGGTGEKEIVRQKGMYYYRAAGITVGAIQIETHDRRYLQPSLGIKTLQSIEKYQVDVLGNYHKVDLPEKRMTFSKEG

SEQ ID NO: 9933 - protein, 147 aa, unidentified
  REGION 1..147: note = Description of Unknown:uncultivated organism sequence
DVFRVPDDGYYFVPIYVADTKKGILPSKAVVAGKSPEAWKQMKPEHFLFSLFKGDLIYVESRKGISLALAEKATGEKTIQVKSGLFYFCGADISTGSIGMEIHDRRYTKRGLGIKTLTLIEKCQVDVLGNVSKVRLPETRLEFRGRK

SEQ ID NO: 9934 - protein, 152 aa, unidentified
  REGION 1..152: note = Description of Unknown:uncultivated organism sequence
DVFRVPNERKPDDNYYFVPIYVADTKKAILPSKAVVGKKPPEAWKQMKPEHFLFSIFKGDLIYVESKKGISLALAKEAVGEKTIQVKSGLFYFCGADISDGSIKIETHDRRYYKKSLGIKELKAFEKRQVEVLGEVRKVKLPEKRLEFRGRK

SEQ ID NO: 9935 - protein, 152 aa, unidentified
  REGION 1..152: note = Description of Unknown:uncultivated organism sequence
DVFKVEGEGYYFVPIYVSDTIKNKLPNKASVASKTYAEWKKMQDKDFIFSLYPRDLFYVKSKNKIKLTSINKQDKESLDTNELFAYYVNADISTAAIACINHNGEYERRGLGIKRLQEFKKYEVDVLGNYHEVKLPEKRQDFSNLKKGGSLK

SEQ ID NO: 9936 - protein, 152 aa, unidentified
  REGION 1..152: note = Description of Unknown:uncultivated organism sequence
DVFRVPNERKSDDSYYFVPIYVADTKKATLPSKAVVKGKAPEAWKQMKPEHFLFSVFKGDLIYVESKKGISLALAKEAVGEKIIQVKSGLFYFCGADISDGSIKIETHDGRYYKKSLGIKELKAFEKRQVDVLGNVSKVRLPETRLEFRGRK

SEQ ID NO: 9937 - protein, 151 aa, unidentified
  REGION 1..151: note = Description of Unknown:uncultivated organism sequence
DVFYIENEGYYLVPVYTKNVIEKNLPNKASIAKKPESEWKEMNDKDFIFSLYPNDLVHIKSKKPIEFIPSENQKLENKLYNDVFAYYVSSDISSASIEIKTHDNEYKRRGLGIKTLLEIKKYEVDVLGEYHEVRIPEKRNDFKNVKGGKKA

SEQ ID NO: 9938 - protein, 147 aa, unidentified
  REGION 1..147: note = Description of Unknown:uncultivated organism sequence
DVFHVEDDGYYFVPIYIADTKKDRLPNKAVIAYKPYQEWKEMAAEDFIFSLYPGDLVRIQSRKGIKLNISKGGTGEKVIVRRDGLYYYRTAGITVGSIQIETHDRRYFQPGVGIKTLQSIEKYQVDVLGNYHKVSLPEKRMPFNKEG

SEQ ID NO: 9939 - protein, 147 aa, unidentified
  REGION 1..147: note = Description of Unknown:uncultivated organism sequence
DVFYVPGDGYYLVPIYVADTQKAVLPNCAVVAHKKYALWKEMDDSDFLFSLYPGDLIRIQSKKGITLNISKGGTGEAKILRKDALFYYCGTDIGSGNISIETHDRQYSQPGLGFKTLLLVEKYQVDVLGNYYKVTSPEKRMPFSKEG

SEQ ID NO: 9940 - protein, 147 aa, unidentified
  REGION 1..147: note = Description of Unknown:uncultivated organism sequence
DVFCIPEDGYYWVPIYVADTQKAVLPSRAAVAYKPYGDWKEMEDSNFLFSLYPGDLIRIQSIKGVKLKIAKNGTGEPEITRKDGMFYYCGANICTGAVRIEAHDRQYSQPGLGFKTLQSVEKYQVDVLGNYYKVTLPEKRMPFTKEG

SEQ ID NO: 9941 - protein, 146 aa, unidentified
  REGION 1..146: note = Description of Unknown:uncultivated organism sequence
DVFYVDGEGYYFIPIYASDVVKDKLPNKACVAGKNYSDWKEMDDKDFIFSLYPKDLVHIKKESKIKLNPREKNKEKIENEEVLGYYVKSDISSASIEIETNDNKYFARGVGIKRLLILEKYEVDILGNYHKAKLPEKRLPFNINKK

SEQ ID NO: 9942 - protein, 149 aa, unidentified
  REGION 1..149: note = Description of Unknown:uncultivated organism sequence
DIFYVEGEGYYFVPIYTADVLKDKLPNKGCIAYKPQSEWKELDDKYFIFSLYPNDLIYLEKEDNIELTSKDKEKIQAKSIFSYYVKAGISTASITIINHDNSYMLPSLGIKGLLSMKKYQVGVLGDIHEVKLPEKRLKFNLKNKKGGKA

SEQ ID NO: 9943 - protein, 145 aa, unidentified
  REGION 1..145: note = Description of Unknown:uncultivated organism sequence
DVFYIEGDGYYYVPIYITDVVKDELPNKAVVRRKLPKDWKKMDDKDFLFSIYPNDLIYVERKEVFELTAPKNSSLDPTISKTKGLFYYRSFDSNTGSFKIYTHDRSYSKKSLGGKTLSCLKKYTVDVLGNYSEVSLPEKRKPLRG

SEQ ID NO: 9944 - protein, 145 aa, unidentified
  REGION 1..145: note = Description of Unknown:uncultivated organism sequence
DVFHVEKDGYYFVPVYVSDTVAKELPNRAVVANKPYEQWKPMKESDFLFSLCAGDLIRICNNKPIKLKQAEGGTGNPELLKKEGLYYYNGLNISSGALHIQLHDRSYSQSSLGGKRLGLIEKYEVDILGNYRPVKLPEQRQRFKR

SEQ ID NO: 9945 - protein, 144 aa, unidentified
  REGION 1..144: note = Description of Unknown:uncultivated organism sequence
DVFHVENEGYYFVPVDVADTVKDELPNRAAVKGKPMEQWKEMDESDFLFSLYSGDLIHIMSGTKITMKLKDGAEGAESIEIDDALLYFSNFDIANAQIDVSTHDRRYTKHGMGVKTLSLIEKYRVDVLGNYTPVKLPEKRMRFK

SEQ ID NO: 9946 - protein, 149 aa, unidentified
  REGION 1..149: note = Description of Unknown:uncultivated organism sequence
DVFYVQGEGYYFVPLYTADTVKPDLPCLAVTTSKKDPSWKRMQEEDFLFSLYSGDLVRIVSSKGIKLNLAKGAEGPASLTVQDALLYYGGFNISTCALNLTTHDGRYWQSGLGGKRLSLIEKYQVDVLGRYSRVSLPEKRMRFSLHGIS

SEQ ID NO: 9947 - protein, 147 aa, unidentified
  REGION 1..147: note = Description of Unknown:uncultivated organism sequence
DVFQVSDDGYYFIPVYVADTKKAMLPSKAVVAHKPYDQWKEMSGQHFIFSLYPGDLIRIRSRKGIKLKLAKGGTGESEISRQDGLYYYRGGDISTGAISISTHDRRYESRGIGIKTLQSIEKYQVDVLGNYHKVNLPEKRIPFTKEG

SEQ ID NO: 9948 - protein, 147 aa, unidentified
  REGION 1..147: note = Description of Unknown:uncultivated organism sequence
DVFQVPDDGYYFIPVYVADTKKAMLPSKAVVAHKPYDQWKEMSGQHFIFSLYPGDLIRIRSRKGIKLKLAKGGTGESEISRQDGLYYYRGGDISTGAISISTHDRRYESRGIGIKTLQSIEKYQVDVLGNYHKVNLPEKRIPFTKEG

SEQ ID NO: 9949 - protein, 149 aa, unidentified
  REGION 1..149: note = Description of Unknown:uncultivated organism sequence
DVFFVENDGYYFIPIYTADVLKEKLPNKACVPGKEWKIIEDKDFIFSLYPNDLIYIENNKGINLKPLNKDNDELVVNKLFAYYVKAGISTASITIINQDKSYEQPSLGLKSLMLIKKYQVGVLGDIHEVKIPEKRVEFNLKNKKGGKKA

SEQ ID NO: 9950 - protein, 145 aa, unidentified
  REGION 1..145: note = Description of Unknown:uncultivated organism sequence
DVFYVENEGYYFVPIYIADTLKEKLPNKACIPGKNYEDWKEMDEKNFIFSLYPNDLIRIVGNGKIKLNGNKDKEKDSIEVDELFAYYIKAGISVASITIVNHDSEYIQPNLGIKSLKSIEKYTVDVLGNYNKVKLPEKRQKFNIK

SEQ ID NO: 9951 - protein, 145 aa, unidentified
  REGION 1..145: note = Description of Unknown:uncultivated organism sequence
DVFYVEGEGYYFVPIYVANTIKKELPNKACVANKGTDKWKTMDDKNFIFSLYPNDLIYIESEKGIKLNGNNDNKKEQIEVKKLFAYYVKAGISVAQITIDNQDGEYTQPSLGIKGLKKIEKYDIDVLGNYHKIKLPEKRIKFNIN

SEQ ID NO: 9952 - protein, 131 aa, unidentified
  REGION 1..131: note = Description of Unknown:uncultivated organism sequence
AVYADSKGKRSYKTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 9953 - protein, 145 aa, unidentified
  REGION 1..145: note = Description of Unknown:uncultivated organism sequence
AVYANDEGKRSFETIDLHCALEMQKQGSSVAPPINENGDKLLFVLSPNDLVYVPSESELQHDIDSEDLKLDHVFKVVSFSENRCCFVPHSMSSPIAAGFEFNSPNKIEVVSRLGLFEQDKETVSIKNICLPIKMDRLGHLHLVKI

SEQ ID NO: 9954 - protein, 131 aa, unidentified
  REGION 1..131: note = Description of Unknown:uncultivated organism sequence
AVYADSKGKRSFNMIDLRTAIECRKQGLSVAPSINEKGEKLLFTLSPNDLVYMPSEEEEANGFSIKGNLIKEHIYKMVSATNRQCFFIPHTVADFISRGQEYNVLNKIELAEDGRSIKEHCVPIKVNRLGK

SEQ ID NO: 9955 - protein, 131 aa, unidentified
  REGION 1..131: note = Description of Unknown:uncultivated organism sequence
AVYADSKGKRSYKTIDLRTAIECRKQGLSVAPSINEKGDKLLFTLSPNDLVYMPSEGEEANGFAIDNDLNKEQIYKMVSATNNRCFFIPHTVADFISRGQEYNSVNKIELTEDGRSIKEHCVPLKVNRLGK

SEQ ID NO: 9956 - protein, 131 aa, unidentified
  REGION 1..131: note = Description of Unknown:uncultivated organism sequence
AVYANSNGKRCFKTIDLRTAIECKKQGLSVAPSVNEKGDKLLFTLSPNDLVYMPSEEEEANGFSIKGNLIKEHIYKMVSANDNRCFFIPHTVVDFISNGEEYNRHNKIELTEDRRSIKEHCVPLKVNRLGK

SEQ ID NO: 9957 - protein, 131 aa, unidentified
  REGION 1..131: note = Description of Unknown:uncultivated organism sequence
AIYADSKGKRSYKTIDLRTAIECRKQGLSVAPSINEKGDKLLFTLSPNDLVYMPSEGEETNGFAIDNNLNKEQIYKMVSATNNRCFFIPHTVADFISRGQEYNSVNKIELTEDGRSIKEHCVPLKVNRLGK

SEQ ID NO: 9958 - protein, 131 aa, unidentified
  REGION 1..131: note = Description of Unknown:uncultivated organism sequence
AVYADSKGKRSYKTIDLRTAIECRKQGLSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 9959 - protein, 131 aa, unidentified
  REGION 1..131: note = Description of Unknown:uncultivated organism sequence
AVYADSNGKRSFKTIDLRTAIECKKQGLSVAPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 9960 - protein, 131 aa, unidentified
  REGION 1..131: note = Description of Unknown:uncultivated organism sequence
AVYVDSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 9961 - protein, 131 aa, unidentified
  REGION 1..131: note = Description of Unknown:uncultivated organism sequence
AVYADSKGKRSFNMIDLRTAIECWKQGVSVAPSINEKGDKLLFTLSPNDLVYMPSEEEEANGFSIKGNLIKEHIYKMVSATNRQCFFIPHTVADFISRGQEYNVLNKIELAEDGRSIKEHCVPLKVNRLGK

SEQ ID NO: 9962 - protein, 131 aa, unidentified
  REGION 1..131: note = Description of Unknown:uncultivated organism sequence
AVYADSKGKRSYKTIDLRTAIECRKQGLSVAPSINEKGDKLLFTLSPNDLVYMPSEWEEANGFAIDNNLNKEQIYKMVSATNNRCFFIPHTVADFISRGEEYNSHNKIELTEDGRSIKEHCVPLKVNRLGK

SEQ ID NO: 9963 - protein, 131 aa, unidentified
  REGION 1..131: note = Description of Unknown:uncultivated organism sequence
AVYADSKGKRSFDMIDLRTAIECWKQGVSVAPSMNEKGDKLLFTLSPKDLVYMPSEEEEANGFSIKGNLIKEHIYKMVSATNRQCFFIPHTVADFISRGQEYNVLNKIELAEDGRSIKEHCVPLKVNRLGK

SEQ ID NO: 9964 - protein, 150 aa, unidentified
  REGION 1..150: note = Description of Unknown:uncultivated organism sequence
AVYANEEGKRSYQSVDLRTAIELKKQGCPVAPETNEKGDKLLFILSPNSLVYMPTEEEMERGNIDVQNLNLNQIFKMVSSTGNECYFVPNTLSQVIFPNKEYESMNKVGTVKEWDGYSISESKNNKKFLSIKACCIPICIDRLGRIQLKK

SEQ ID NO: 9965 - protein, 112 aa, unidentified
  REGION 1..112: note = Description of Unknown:uncultivated organism sequence
AVYANSNGKRSYKTIDLRTAIECKKQGLSVAPSVNEKGDKLLFTLSPNDLVYMPSEEEEANGFSIKGNLIKEHIYKMVSANDNRCFFIPHTVAEYCIFLYVFLRLCGQIKEH

SEQ ID NO: 9966 - protein, 131 aa, unidentified
  REGION 1..131: note = Description of Unknown:uncultivated organism sequence
AVYVDSKGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVDRLGK

SEQ ID NO: 9967 - protein, 134 aa, unidentified
  REGION 1..134: note = Description of Unknown:uncultivated organism sequence
AVYADSNGKRSFKTIDLRTAIECKKQGLSVAPSVNEKGEQLLFTLSPNDLVYMPSEEEEANGFAIDNNLNKEHIYKMVSTDSNRCFFIPHTVANFISRGEEYNRHNKIELTEDRRSIKEHCVPLKVNRLGKKTL

SEQ ID NO: 9968 - protein, 131 aa, unidentified
  REGION 1..131: note = Description of Unknown:uncultivated organism sequence
AVYADSKGKRSFKTIDLRTAIECKKQGLSVAPSVNEKGDKLLFTLSPNDLVYMPSEEEEANGFAIKGNLIKEHIYKMVNASNNRCFFIPHSVADFISKGEEYNALNKIELTEDGRSIKVHCVPLKVNRLGK

SEQ ID NO: 9969 - protein, 131 aa, unidentified
  REGION 1..131: note = Description of Unknown:uncultivated organism sequence
AVYADSKGKRSYKTIDLRTAIECRKQGLSVAPSINEKGDKLLFTLSPNDLVYMPSEGEEANGFAIDNNLNKEQIYKMVSANNKQCFFIPHTVADFISNGEEYNRHNKIELTEDRRSIKEHCVPLKVNRLGK

SEQ ID NO: 9970 - protein, 131 aa, unidentified
  REGION 1..131: note = Description of Unknown:uncultivated organism sequence
AVYANSNGKRSYKTIDLRTAIECKKQGLSVAPSVNEKGDKLLFTLSPNDLVYMPSEEEEANGFSIKGNLIKEHIYKMVSANDNRCFFIPHTVADFISNGEEYNRHNKIELTEDRRSIKEHCVPLKVNRLGK

SEQ ID NO: 9971 - protein, 131 aa, unidentified
  REGION 1..131: note = Description of Unknown:uncultivated organism sequence
AVYANSNGKRSYKTIDLRTAIECKKQGLSVAPSVNEKGDKLLFTLSPNDLVYMPSEEEGANGFSIKGNLIKEHIYKMVSANDNRCFFIPHTVADFISNGEEYNRHNKIELTEDRRSIKEHCVPLKVNRLGK

SEQ ID NO: 9972 - protein, 150 aa, unidentified
  REGION 1..150: note = Description of Unknown:uncultivated organism sequence
AVYANEEGKRSYQSVDLRTAIELKKQGCPVAPETNEKGDKLLFILSPNSLVYMPTEEEMERGNIDVQNLNLNQIFKMVSSTGNNCFFVPNTLSQVIFPGKEYESMDKVGTVKEWDGYSISESKNNKKFLSIKACCIPICIDRLGRIQLKK

SEQ ID NO: 9973 - protein, 131 aa, unidentified
  REGION 1..131: note = Description of Unknown:uncultivated organism sequence
AVYADSNGKRSFKTIDLRTAIECKKQGLSVSPSVNEKGDKLLFTLSPNDLVYMPSEEEEANGFSIDNNLNKEQIYKMVSATYKQCFFIPHTVADFIYKNKEFNVLNKIELTEDRRSIKEHCVPLKVNRLGK

SEQ ID NO: 9974 - protein, 131 aa, unidentified
  REGION 1..131: note = Description of Unknown:uncultivated organism sequence
AVYADSKGKRSYKTIDLRTAIECRKQGLSVAPSVNQKGDKLLFTLSPNDLVYMPSEEEEVNGFAIDNNLNKDQIYKMVSANNKQCFFIPHTVADFISRGEEYNSHNKIELTEDRRSIKEHCVPLKVNRLGK

SEQ ID NO: 9975 - protein, 131 aa, unidentified
  REGION 1..131: note = Description of Unknown:uncultivated organism sequence
AVYADSKGKRSYNTIDLRTAIECRKQGLSVAPSINEKGDKLLFTLSPNDLVYMPSEGEEANGFAIDNNLNKDQIYKMVSANNKQCFFIPHTVADFISRGEEYNSHNKIELTEDRRSIKEHCVPLKVNRLGK

SEQ ID NO: 9976 - protein, 131 aa, unidentified
  REGION 1..131: note = Description of Unknown:uncultivated organism sequence
AVYADSKGKRSYKTIDLRTAIECRKQGLSVAPSTNEKGDKLLFTLSPNDLVYMPSEGEEANGFSIDNYLNKEQIYKMVSATYKQCFFIPHTVADFIYKNKEFNVLNKIELTEDRRSIKEHCVPLKVNRLGK

SEQ ID NO: 9977 - protein, 131 aa, unidentified
  REGION 1..131: note = Description of Unknown:uncultivated organism sequence
AVYADSKGKRSFNMIDLRTAIECRKQGLSVAPSINEKGEKLLFTLSPNDLVYMPSEEEEANGFSIKDNLIKEHIYKMVSATNRQCFFIPHTVADFISRGQEYNVLNKIELAEDGRSIKEHCVPIKVNRLGK

SEQ ID NO: 9978 - protein, 131 aa, unidentified
  REGION 1..131: note = Description of Unknown:uncultivated organism sequence
AVYADQKGKRSFKTIDLRTAIECRKQGVSVAPSINEKGDKLLFTLSPNDLVYMPSEGEEANGFAIDNNLNKEQIYKMVSATNNRCFFIPHTVADFISRGQEYNSVNKIELTEDGRSIKEHCVPLKVNRLGK

SEQ ID NO: 9979 - protein, 134 aa, unidentified
  REGION 1..134: note = Description of Unknown:uncultivated organism sequence
AVYADSNGKRSFKTIDLRTAIECKKQGLSVAPSVNEKGEQLLFTLSPNDLVYMPSEEEEANGFAIDNNLNKEHIYKMVSTDSNRCFFIPHTVADFISRGEEYNRHNKIELTEDRRSIKEHCVPLKVNRLGKKTL

SEQ ID NO: 9980 - protein, 131 aa, unidentified
  REGION 1..131: note = Description of Unknown:uncultivated organism sequence
AVYVDSKGKRSYKTIDLRTAIECKKQGLSVAPSVNEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 9981 - protein, 131 aa, unidentified
  REGION 1..131: note = Description of Unknown:uncultivated organism sequence
AVYADSKGKRSYKTIDLRTAIECRKQGLSVAPSINEKGDKLLFTLSPNDLVYMPSEGEEANGFAIDNNLNKEQIYKMVSANDNRCFFIPHTVADFISNGEEYNRHNKIELTEDRRSIKEHCVPLKVNRLGK

SEQ ID NO: 9982 - protein, 131 aa, unidentified
  REGION 1..131: note = Description of Unknown:uncultivated organism sequence
AVYADQKGKRSFKTIDLRTAIECRKQGLSVAPSINEKGDKLLFTLSPNDLVYMPSEEEEANGFSIKGNLIKEHIYKMVSANNRQCFFIPHSVADFISKGEEYNAHNKIELAEDGRSIKVHCVPLKVNRLGK

SEQ ID NO: 9983 - protein, 136 aa, unidentified
  REGION 1..136: note = Description of Unknown:uncultivated organism sequence
LKAVENNNYNERDKNGQIILTAPKNVQLLSSIFDKLRSKPFSNNKWNIYFSIVNGKETKVEQLFSKLSIDKQAEVISQIVIWINSSRQNVNLSLIGGSAHSGTQALSKTVSRLNECMLISQSITGIYEHSVDLLTI

SEQ ID NO: 9984 - protein, 130 aa, unidentified
  REGION 1..130: note = Description of Unknown:uncultivated organism sequence
EKAVSGQYFEEKREGQLIITEERNQKLYDILLEKLTDGIYRNKKASLQTILQEGREKFIRLSIPNQCQILMNLVEWFQLSCVTADMKEIGGSANSGKCLMGKKISDCSEMILITQSATGLQERRIDLLKL

SEQ ID NO: 9985 - protein, 130 aa, unidentified
  REGION 1..130: note = Description of Unknown:uncultivated organism sequence
EKAVSGQYFEEKREGQLIITEECNQKLYDILLEKLTDGIYRNKKASLQTILQEGREKFIRLSIPNQCQILMNLVGWFQLSCVTADMKEIGGSVNSGKCLMGKKISDCSEMILITQSATGLQERRIDLLKL

SEQ ID NO: 9986 - protein, 131 aa, unidentified
  REGION 1..131: note = Description of Unknown:uncultivated organism sequence
IKAVGKGYYEETDENGQIIITGERNMKFFNTLGSKLNARPYNNNRWNIYKIMENKEEIFAGLSIEKQCYVINQIISWINSKTQNVDLSDIKGSSHSGTMPLNKKISECSQFELIYQSVTGMYEKRTDLLKL

SEQ ID NO: 9987 - protein, 131 aa, unidentified
  REGION 1..131: note = Description of Unknown:uncultivated organism sequence
MKAIEIDNYEEIDKDSNAIITEEKNVALFDVLCVKLNSEPYINNRWNICKTLEGKEEIFKNLDIKKQCYVIGQIISWINSAMQNVNLKDVCGSEHAGTQTLNKKISESKECILIHQSVTGMYERKIDLLSI

SEQ ID NO: 9988 - protein, 131 aa, unidentified
  REGION 1..131: note = Description of Unknown:uncultivated organism sequence
MKAIEIDDYKEVGKNGKAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 9989 - protein, 131 aa, unidentified
  REGION 1..131: note = Description of Unknown:uncultivated organism sequence
MKAIEIDNYEEIDKDSNAIITEEKNAALFNTLSVKLNSEPYINNQWNIYKILEGKEEIFKDLDIQKQCYVIVKIIDWIKSKTQGVDLTDIQGKNQSGTMKVNKRISECKECILIHQSVTGMYERRIDLLSI

SEQ ID NO: 9990 - protein, 131 aa, unidentified
  REGION 1..131: note = Description of Unknown:uncultivated organism sequence
MKAIDIDSYEEIDKDGNAIITEEKNVALFGALSVKLNSEPYINNRWNIYKILDGKEEIFKNLDIKKQCYVISQIIAWINSSTPNVNLKDVCGSEHSGMQRLNKKISECKECILIHQSVTGMYERRIDLLSI

SEQ ID NO: 9991 - protein, 131 aa, unidentified
  REGION 1..131: note = Description of Unknown:uncultivated organism sequence
IKAVGKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 9992 - protein, 131 aa, unidentified
  REGION 1..131: note = Description of Unknown:uncultivated organism sequence
IKAVGKGYYEETDKNGQIIITGERNMEFFNTLGSKLNARPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 9993 - protein, 131 aa, unidentified
  REGION 1..131: note = Description of Unknown:uncultivated organism sequence
MKAIEIDNYEEIDKYSNAIITEEKNVALFDVLSVKLNSEPYINNRWNICKTLEGKEEIFKNLDIKKQCYVIGQIISWINSAMQNVNLKDVCGSEHSGMQQLNKKISECKECILIHQSVTGMYERRIDLLSI

SEQ ID NO: 9994 - protein, 131 aa, unidentified
  REGION 1..131: note = Description of Unknown:uncultivated organism sequence
MKAIEIDNYEEIDKDSNAIITEEKNVDLFDVLSVKLNSEPYINNRWNIYKTLDGKKEIFENLDIKKQCYVISQIIFWINSSTQSVNLKDVCGSEHSGMQPLNKKISECKECILIHQSVTGMYERRIDLLSI

SEQ ID NO: 9995 - protein, 131 aa, unidentified
  REGION 1..131: note = Description of Unknown:uncultivated organism sequence
IKAVDKGYYEETDKNGQIIITGERNMKIFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 9996 - protein, 131 aa, unidentified
  REGION 1..131: note = Description of Unknown:uncultivated organism sequence
MKAIEIDNYEEIDKDSNAIITEEKNVALFDVLCVKINSEPYINNQWNIYKILEGKEEIFKNLDIKKQCYIIGQIISWINSSTQNVNLKDVCGSEHSGMQRLNKKISECKECILIHQSVTGMYERRIDLLSI

SEQ ID NO: 9997 - protein, 131 aa, unidentified
  REGION 1..131: note = Description of Unknown:uncultivated organism sequence
IKAVGKGYYEETDENGQIIITGERNMKFFNTLSSKLNNRPYNNNRWNIYKIMENKEEIFAGLSIEKQCYVINQIISWINSKTQNVDLSDIKGSSHSGTMTLNKKISECSQFELIYQSVTGMYEKRTDLLKL

SEQ ID NO: 9998 - protein, 131 aa, unidentified
  REGION 1..131: note = Description of Unknown:uncultivated organism sequence
TKAIDITNYEEIDENGNVIITQEKNTKLFNVLCEKLNNKPYRYNRWNIYNVLEGKEETFRKLDVEKQCYIINQIILWVNSAVQNINLKYINGKEHEGSLHMNKKISEYDEAVLIQQSVTGMYERKTDLLKV

SEQ ID NO: 9999 - protein, 131 aa, unidentified
  REGION 1..131: note = Description of Unknown:uncultivated organism sequence
IKAVSKGYYEETDKNGQIIITDERNMKFFNTLGSKLNARPYCNNRWNIYKIMENKEEIFAGLSIEKQCYVINQIISWINSKTQNVDLSDIKGGSHSGTMTLNKKISECSQFELIYQSVTGMYEKRTDLLKL

SEQ ID NO: 10000 - protein, 131 aa, unidentified
  REGION 1..131: note = Description of Unknown:uncultivated organism sequence
MKAIEIDDYKEVGKNGNAVITKENNMILFDTLSAKLKSEPYIHNRCNIYKILEGKEKIFKDLDIQKQCYVIVKIIDWIKSKTQGVDLTDIQGKKQSGTMKINKRISECRECILIHQSVTGMYERRIDLLSI

SEQ ID NO: 10001 - protein, 131 aa, unidentified
  REGION 1..131: note = Description of Unknown:uncultivated organism sequence
MKAIEIDNYEEIDKDSNAIITEEKNVALFDVLCVKINSEPYINNRWNIYKILEGKEEIFKNLDIEKQCYIIGQIISWINSSTQNVNLKDVCGSEHSGMQQLNKKISECKECILIHQSVTGMYERRIDLLSI

SEQ ID NO: 10002 - protein, 131 aa, unidentified
  REGION 1..131: note = Description of Unknown:uncultivated organism sequence
MKAIEIDNYEEIDKDSNAIITEEKNVALFDVLCVKINSEPYINNQWNIYKILEGKEEIFKKLDIKKQCYIIGQIISWINSSTQNVNLKDVCGSEHSGMQRLNKKISECKECILIHQSVTGMYERRIDLLSI

SEQ ID NO: 10003 - protein, 131 aa, unidentified
  REGION 1..131: note = Description of Unknown:uncultivated organism sequence
TKAIDITNYEEIDENGNVIITHEKNTKLFNVLCEKLNNKPYINNRWNIYNVLEGKEEIFRKLDVEKQCYIINQIILWGNSAVQNINLKYINGKEHEGSLLMNKKISEYDEVVLIQQSVTGMYERKTDLLKV

SEQ ID NO: 10004 - protein, 131 aa, unidentified
  REGION 1..131: note = Description of Unknown:uncultivated organism sequence
LKGLEKNDYQEIDKDHNLILTPEKNMALYRALMQKLQGNPFVHNKWNIYRTLEGKEAVFAGLNMENQCYVVNQILMWITSSTQSVDLQLMRGSKHSGIMLMNKKISVAKEFVLIHQSVTGIYETKTDLLLV

SEQ ID NO: 10005 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 10006 - protein, 150 aa, unidentified
  REGION 1..150: note = Description of Unknown:uncultivated organism sequence
AVYRDAEGNLQEKIVSFYEASIKAILGEPIVDVNYNKTEGWQFLFTMKQNEYFVFPNAETGFDPNEIDLLNPNNYAAISPNLFRVQTMSKVTYGNTIVRDYKFRHHLETTVDDSSSLKNITYKQYKTLDFAYGIVKVRVNHIGRIVSVGE

SEQ ID NO: 10007 - protein, 144 aa, unidentified
  REGION 1..144: note = Description of Unknown:uncultivated organism sequence
AIYRDEKGQLQEDVVSFYKAITRASLGLPVVDKEYKKSEGWEFLFSMKQNEYFVFPNEKTGFNPDEVDLMNPDNYALISPNLFRVQTIASKDYRFRHHLETKVEDNKKELQDITWKRIRSLGYLNNLVKVRVNHIGQIVSIGEY

SEQ ID NO: 10008 - protein, 155 aa, unidentified
  REGION 1..155: note = Description of Unknown:uncultivated organism sequence
AIYRDENGELQENVVSFYEATKRATEGKPIIDRDFNKSKGWHFLFTMKQNEYFVFPKYETVKDQAVDEKTVMSFNPMNIDLLDPANYSIISPNLYRVRKISTKDYCFRHHLETTVTEDKNLRDTTWKRIQNPGDLNAIIKIRVNHIGQIVQVGEY

SEQ ID NO: 10009 - protein, 142 aa, unidentified
  REGION 1..142: note = Description of Unknown:uncultivated organism sequence
AIYKDENGNLQENVISFFEATTRASLGLPIIDKTYKTDEGWQFLFSMKQNEYFVFSNDKTGFNPKEIDLLNPDNYHLISPNLFRVQKFTTKDYVFRHHLETTVESHNLLKDITWLRLGINGIRNVTKVRVNHIGLIVSVGEY

SEQ ID NO: 10010 - protein, 142 aa, unidentified
  REGION 1..142: note = Description of Unknown:uncultivated organism sequence
AIFRDVEGNLQEHVVSFYEATARAIQHLPVIDKDYKKDEGWQFLFTMKQNEYFVFPNSGTGFDPKEIDLLDPRNYAEISKNLYRVQKLSLKDYVFRHHLETTVSDKKEMSGITWKRCGLSGIKGIVKVRVNHLGQIVSVGEY

SEQ ID NO: 10011 - protein, 143 aa, unidentified
  REGION 1..143: note = Description of Unknown:uncultivated organism sequence
AIFRDVEGNLQEHVVSFYEATARAIQHLPVIDKDYKKDEGWQFLFTMKQNEYFVFPNSGTGFDPKEIDLLDPRNYAEISKNLYRVQKLSTKNYFFRHHLETSVEDKKELKGIAWKNIRTPEGLGELVKVRVNHLGQIVSVGEY

SEQ ID NO: 10012 - protein, 142 aa, unidentified
  REGION 1..142: note = Description of Unknown:uncultivated organism sequence
AIYCDADGNLQENVVSFYEATMRANQGMPIIDKTYRKNEGWQFLFTMKQNEYFVFPNPETGFNPNDIDLLDSKNYHLISPNLFRVQKLATKDYWFRQHLETTVENKKELFEITWKRITALNNLIGIVKVRVNHIGQIVSVGE

SEQ ID NO: 10013 - protein, 146 aa, unidentified
  REGION 1..146: note = Description of Unknown:uncultivated organism sequence
AIYMDADGKMQDDIVSFYEATMRANQGYPVIDRDKNRSEGWQFLFTMKQNEYFVFPNEETGFDPNEIDLLDPNNYPIISPNLFRVQKLSKTEGRIYMFRHHLETTVDDKKELQEVTWKRINSLDKLKNVVKVRVDHVGRIVSVGEY

SEQ ID NO: 10014 - protein, 143 aa, unidentified
  REGION 1..143: note = Description of Unknown:uncultivated organism sequence
AIYRDEKGVLQERVVSFYEATASASVGLPVVDKEYRKSEGWTFLFSMKQNEYFVFPNEKNGFNPNEIDLMDPDNYALISPNLFRVQKIASKDYVFRHHLETTVEDRKELQNITWKRFQSLTNLDKLVKVRVNHIGQIVSVGEY

SEQ ID NO: 10015 - protein, 143 aa, unidentified
  REGION 1..143: note = Description of Unknown:uncultivated organism sequence
AIYEDEEGKWHEKVVSFNEAASRAIQKFPIIDKDFNKELGWVFQFTMKPNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 10016 - protein, 143 aa, unidentified
  REGION 1..143: note = Description of Unknown:uncultivated organism sequence
AIYEDEEGKWHEKVVSFNEAASRAIQKFPIIDKDFNKELGWVFQFTMKQNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 10017 - protein, 160 aa, unidentified
  REGION 1..160: note = Description of Unknown:uncultivated organism sequence
VIYRVPQKGKDGKLKYDKDGNLEYEIVDIVVPFYEAVRRKSEGLDVIDKNLNKEEGWEFLFSMKQNEYFVFPNEKTGFDPTKIELNDPKNYSAISPNLFRVQKFSKGDYMFRHHLETTVKNESKEMKDILYKRITSLKQFENMVKVRVNHIGEIVDVGEK

SEQ ID NO: 10018 - protein, 143 aa, unidentified
  REGION 1..143: note = Description of Unknown:uncultivated organism sequence
AIYRDECGALQEKVVSFYEATTRASLNLPIVDREYKCSEGWTFLFSMKQNEYFVFPNEKTGFNPAEIDLLDPDNYALISPNLFRVQKLATKYYVFRHHLETMVEDRKELQEITWKRLSSLNNIDKLFKVRVNHIGQIVYTGEY

SEQ ID NO: 10019 - protein, 143 aa, unidentified
  REGION 1..143: note = Description of Unknown:uncultivated organism sequence
AIYRDADGNLQENVVSFYEATMRANMEMPIIDKDYKKAEGWQFLFTMKQNEYFLFPNQETGFNPNEIDLLNPDNYAEISKNLFRVQKLASKYYVFRHHLETTVDDNKNLQEVTWKRITNINKLKDVVKVRINHIGQIVAVGEY

SEQ ID NO: 10020 - protein, 143 aa, unidentified
  REGION 1..143: note = Description of Unknown:uncultivated organism sequence
AIYRDEKGELQENVVSFYEATARAILGEAIVNKAYNDSEGWSFLFSMKQNEYFVFPNENTGFDPNEIDLLDPDNYALISPNLYRVQKITSKDYVFRHHLETTVENKKELQNITWKRVTSLTNFDKIVKVRINHIGQIVFVGEY

SEQ ID NO: 10021 - protein, 142 aa, unidentified
  REGION 1..142: note = Description of Unknown:uncultivated organism sequence
AIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNVDTPKELSGITYARLSLKGIVGIVKVRVNHLGEIVAVGEY

SEQ ID NO: 10022 - protein, 143 aa, unidentified
  REGION 1..143: note = Description of Unknown:uncultivated organism sequence
AIFRDADGNLQEHMVSFYEATARAIQHLPIIDKEYNKDLGWQFLFTMKQNEYFVFPNEETGFNPKDIDLLNPKNYALISPNLFRVQKLSSKDYVFRHHLETKVEYNKELFGVIWKRIKSLGKIKDIVKVRINQIGKIEDLGEY

SEQ ID NO: 10023 - protein, 70 aa, unidentified
  REGION 1..70: note = Description of Unknown:uncultivated organism sequence
AIYKDADGNIKEQAVPFYIATNRVIHKQPAVDRNFNADKGWVVSIVTKIRILKQITTPRPRARSLAKLYL

SEQ ID NO: 10024 - protein, 143 aa, unidentified
  REGION 1..143: note = Description of Unknown:uncultivated organism sequence
AIYRDGKGNLQEKVVSFYEATSRIALGLPIIDKAYKSSEGWNFLFSMKQNEYFVFPNEEIGFNPSEIDLTDAENYALISPNLFRVQKLTSKDYVFRHHLETIVDDKKELHGITWKRLSSLNNLDKIVKVRVNHIGQIVFVGEY

SEQ ID NO: 10025 - protein, 143 aa, unidentified
  REGION 1..143: note = Description of Unknown:uncultivated organism sequence
AIFCDSEGNIQEHLVSFYEAVARAIQHLPVIDRTFNRDKGWQFMFTMKKNEYFVFPNKKTGFDPNEIDLLNPKNYAAISPNLYRTQTLSSRDYFFRHHLETTVDNKKELQGITWKRIRSLDNLRNIVKVRINHLGHIVDFGEY

SEQ ID NO: 10026 - protein, 56 aa, unidentified
  REGION 1..56: note = Description of Unknown:uncultivated organism sequence
AIYKDADGNIKEQAVPFYIATNRVIHKQPAVDRNFNADKGWKFLFSIKKNEYFVFS

SEQ ID NO: 10027 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHYLETTVDTNNALNGTTWKHVQSLKALENIIKVRVNNIGQIVAVGEY

SEQ ID NO: 10028 - protein, 151 aa, unidentified
  REGION 1..151: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 10029 - protein, 143 aa, unidentified
  REGION 1..143: note = Description of Unknown:uncultivated organism sequence
AIYRDANDNLQENIISFFEATTRASLGLPIVDKEYKKSEGWTFLFSMKQNEYFVFPNKETGFDPSEIDLTDPDNYARISPNLFRVQKIATKDYTFRHHLETTVNTTKELQGLTWLRISSLNNLDKLAKVRINHIGQIISVGEY

SEQ ID NO: 10030 - protein, 143 aa, unidentified
  REGION 1..143: note = Description of Unknown:uncultivated organism sequence
AIYEDEEGKWHEKVVSFNEAASRAIQKLPIIDKDFNKELGWVFQFTMKQNEMFVFPDKESGFDPLAIDLKDPANKSLISKHLYRVRSISSNDYRFCHHLETTVATPKELKDITWKRIRSLSSLQGIIKVRVNHIGQIIDIGEY

SEQ ID NO: 10031 - protein, 151 aa, unidentified
  REGION 1..151: note = Description of Unknown:uncultivated organism sequence
AIYKDAKDKLQDNVVSFFEATSRVNLGLPIIDRDYYNDEGWEFKFSLKQNEYFVFPNEKTGFNPKDIDLLDADNYYLISPNLYRVQKFSKVIYGNAAVRDYVFRHHLESSIQDNKNMKDITYKSIKSLPIFDSIVKVRINHLGLIISTGEY

SEQ ID NO: 10032 - protein, 151 aa, unidentified
  REGION 1..151: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAVISANLFRVQTMSKLQYGNSFVRDYKFRHHLETTLNDNKELRDITYKQFKSLNFADTIVKVRVNNIGQIVAVGEY

SEQ ID NO: 10033 - protein, 142 aa, unidentified
  REGION 1..142: note = Description of Unknown:uncultivated organism sequence
AIFRDKDGNLQEHVVSFFEATERAQQQLPIVDYEYNKHLGWQFLFTMKRNEYFVFPNEKTGFDPNEVDLLDPKNAAEISKNLFRVQKLTTKDYFFRHHLETNGDTPKELSGITYARLGLKGIVGIVKVRVNHLGEIVAVGEY

SEQ ID NO: 10034 - protein, 143 aa, unidentified
  REGION 1..143: note = Description of Unknown:uncultivated organism sequence
AIFRDANGNLQEHIVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 10035 - protein, 143 aa, unidentified
  REGION 1..143: note = Description of Unknown:uncultivated organism sequence
AIFRDAEGNLQEHMVSFYEATARAIQHLPIIDKEYNKDLGWQFLFTMKQNEYFVFPNEETGFNPKEIDLLDPQNYALISPNLFRVQKLSSKDYFFRHHLETKVEYNKELFGITWKRINTLSKIKDIVKVRINQVGQIVSVGEY

SEQ ID NO: 10036 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAVISANLFRVQKITTKDYFFRHHLETSVENNKSLCDITWKRITSLNKLQGIVKVRVNNIGQIVAVGEY

SEQ ID NO: 10037 - protein, 143 aa, unidentified
  REGION 1..143: note = Description of Unknown:uncultivated organism sequence
AIFRDKDGNLQEHVVSFFEATERAQQQLPIVDYEYNKHLGWQFLFTMKRNEYFVFPNEKTGFDPNEVDLLDPKNAEEISKNLFRVQKLATKNYCFRHHLETSSETPKELSGITYKWQLGLKGIVGIVKVRVNHLGEIVAVGEY

SEQ ID NO: 10038 - protein, 151 aa, unidentified
  REGION 1..151: note = Description of Unknown:uncultivated organism sequence
AIFRDANGNLQEHVVSYFEATARAIQHLPIVDRDYNKDEGWQFLFTMKRNEYFVFPNEKTEFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 10039 - protein, 143 aa, unidentified
  REGION 1..143: note = Description of Unknown:uncultivated organism sequence
AIFCDAEGNLQEHVVSFYEATARAIQHLPIIDKDYKKDEGWQFLFTMKQNEYFVFPNSETGFDPKEVELLDPKNYADISKNLYRVQKISTKNYFFRHHLETTVEENKELKGVTYKPQLGLNGIKGIVKVRVNHLGQIVSVGEY

SEQ ID NO: 10040 - protein, 64 aa, unidentified
  REGION 1..64: note = Description of Unknown:uncultivated organism sequence
AIFRDADGNLQEHVVSYFEATARAIQHLPIVDRDYKKAEGWQFLFTMKRNEYFVFPNEKTGFNP

SEQ ID NO: 10041 - protein, 143 aa, unidentified
  REGION 1..143: note = Description of Unknown:uncultivated organism sequence
AIFRDAEGNLQEHVVSFYEATARAIQHLPVIDRDYNKAVGWQFLFTMKQNEYFVFPNAETGFDPKEIDLLDPKNYAAISPNLFRVQKIATKNYFFRHHLETTVETPKELAGITYKPQLGLNGIKGIIKVRVNHLGQIVSVGEY

SEQ ID NO: 10042 - protein, 143 aa, unidentified
  REGION 1..143: note = Description of Unknown:uncultivated organism sequence
AIFRDADGNLQEHVVSYFEATARAIQHLPVVDRDYKKAEGWQFLFTMKRNEYFVFPNEKTGFNPKEIDLLDPKNYAVISANLFRVQKLSTKYYCFRHHLETSVKEEKLLFDITWKRCRSPKELQGTIKVRVNNIGQIVAIGEY

SEQ ID NO: 10043 - protein, 151 aa, unidentified
  REGION 1..151: note = Description of Unknown:uncultivated organism sequence
AIFRDANGNLQEHVVSYFEATARAIQHLPIVDRDYNKDEGWQFLFTMKRNEHFVFPNEKTEFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 10044 - protein, 143 aa, unidentified
  REGION 1..143: note = Description of Unknown:uncultivated organism sequence
AIFLDEKGNLQEHVVSFFEATERSRQHLPIVDREYNKHLEWKFLFTMKRNEYFVFPNEKTGFNPNEIDLLDPNNAAEISKNLFRVQKLATKNYFFRHHLETNVDTPKELSGITYKSQLGLKGIVGIVKVRINHLGQIVAVGEY

SEQ ID NO: 10045 - protein, 143 aa, unidentified
  REGION 1..143: note = Description of Unknown:uncultivated organism sequence
AIFRDANGNLQEHVVSYFEATARAIQHLPIVDRNYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 10046 - protein, 143 aa, unidentified
  REGION 1..143: note = Description of Unknown:uncultivated organism sequence
AIFRDVEGNLQEHVVSFYEATARAIQHLPVIDKDYKKDEGWQFLFTMKQNEYFVFPNSGTGFDPKEIDLLDPRNYAEISKNLYRVQKLSSKYYVFRHHLETSVEDKKELKGIAWKNIRTPEGLGELVKVRVNHLGQIVSVGEY

SEQ ID NO: 10047 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAEISDNLFRVQKITTKDYFFRHHLETSVENNKSLCDITWKRCRSPKELQGIVKVRVNNIGQIVAVGEY

SEQ ID NO: 10048 - protein, 143 aa, unidentified
  REGION 1..143: note = Description of Unknown:uncultivated organism sequence
AIFRDAEGNLQEHIVSFFEATMRASQHLPVIERDYNKELGWQFLFTMKQNEYFVFPNEKTGFNPNETDLLDPKNYAEISRNLFRVQKLATKDYWFRHHLETTTNTTKELSNLIWRRVTALNKLNGIIKVRVNHIGQIVAVGEY

SEQ ID NO: 10049 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRITSLKALENVIKVRVNNIGQIVAVGEY

SEQ ID NO: 10050 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEVDLLDPKNYAVISDNLFRVQKITTKDYFFRHHLETSVENNKSLCDITWKRCRSPKELQGIVKVRVNNIGQIVAVGEY

SEQ ID NO: 10051 - protein, 143 aa, unidentified
  REGION 1..143: note = Description of Unknown:uncultivated organism sequence
AIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVTWKRINTLSKIKDIVKVRINQVGKIEDLGEY

SEQ ID NO: 10052 - protein, 151 aa, unidentified
  REGION 1..151: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAVISDNLFRVQTMSKLQYGNSIVRDYKFRHHLETTLNDNKELRDITYKQFKSLNFADTIVKVRVNNIGQIVAVGEY

SEQ ID NO: 10053 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEFDLLDPKNYAVISDNLFRVQKITTKDYFFRHHLETSVENNKSLCDITWKRITSLNKLQGIVKVRVNNIGQIVAVGEY

SEQ ID NO: 10054 - protein, 142 aa, unidentified
  REGION 1..142: note = Description of Unknown:uncultivated organism sequence
AIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLSLKGIVGIVKVRVNHLGEIVAVGEY

SEQ ID NO: 10055 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAVISDNLFRVQKLSTKYYCFRHHLETNVEEEKLLFDITWKRCRSPKELQGIVKVRVNNIGQIVAVGEY

SEQ ID NO: 10056 - protein, 143 aa, unidentified
  REGION 1..143: note = Description of Unknown:uncultivated organism sequence
AIFRDADGNLQEHVVSYFEATARAIQHLPIIDRDYKKAEGWQFLFTMKRNEYFVFPNEKTGFNPKEIDLLDPKNYAVISANLFRVQKLATKDYFFRHHLETSVKEEKLLFDITWKRCRSPKELQGTIKVRVNNIGQIVAIGEY

SEQ ID NO: 10057 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNENTGFNPAEIDLLNPDNNKIISPNLFRVQKISPGDYFFRHHLETTVDANNALKGTTWIRITSLKALENVIKVRVNNIGQIVAVGEY

SEQ ID NO: 10058 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEFDLLDPKNYAVISDNLFRVQKITTKDYFFRHHLETNVENNKSLCDITWKRITSLNKLQGIVKVRVNNIGQIVAVGEY

SEQ ID NO: 10059 - protein, 143 aa, unidentified
  REGION 1..143: note = Description of Unknown:uncultivated organism sequence
AIFTDSEGNLQEHVVSFYEATAMAILGYPVVDRQYNKGLGWKFLFSMNQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 10060 - protein, 143 aa, unidentified
  REGION 1..143: note = Description of Unknown:uncultivated organism sequence
AIFRDKDGNLQEHVVSFFEATERAQQQLPIVDYEYNKHLGWQFLFTMKRNEYFVFPNEKTGFDPNEVDLLDPKNAAEISKNLFRVQKLATKNYCFRHHLETSSETPKELSGITYKWQLGLKGIVGIVKVRVNHLGEIVAVGEY

SEQ ID NO: 10061 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 10062 - protein, 143 aa, unidentified
  REGION 1..143: note = Description of Unknown:uncultivated organism sequence
AIFRDADGNLQEHVVSYFETTARAIQHLPIVDRDYKKAEGWQFLFTMKRNEYFVFPNEKTGFSPKEIDLLDPKNYAVISANLFRVQKLTTKDYFFRHHLETSVKEEKLLFDITWKRITSLNKLQGIIKVHVNNIGQIVAIGEY

SEQ ID NO: 10063 - protein, 143 aa, unidentified
  REGION 1..143: note = Description of Unknown:uncultivated organism sequence
AIYRDEKGVLQERVVSFYEATASASVGLPVVDKEYRKSEGWTFLFSMKQNEYFVFPNEKNGFNPNEIDLMDPDNYALISPNLFRVQKITSKDYVFRHHLETTVEDRKELQNITWKRFQSLTNLDKLVKVRVNHIGQIVSVGEY

SEQ ID NO: 10064 - protein, 143 aa, unidentified
  REGION 1..143: note = Description of Unknown:uncultivated organism sequence
AIFRDADGNLQEHVVSYFEATARAIQHLPIVDRDYKKAEGWQFLFTMKRNEYFVFPNEKTGFNPKEIDLLDPKNYAVISANLFRVQKLSTKYYCFRHHLETNVEEEKLLFDITWKRITSLNKLQGIVKVRVNNIGQIVAIGEY

SEQ ID NO: 10065 - protein, 142 aa, unidentified
  REGION 1..142: note = Description of Unknown:uncultivated organism sequence
AIFRDKDGNLQEHVVSFFEATERAQQQLPIVDYEYNKHLGWQFLFTMKRNEYFVFPNEKTGFDPNEVDLLDPKNAAEISKNLFRVQKLATKDYFFRHHLETNVDTPKELSGITYARLGLKGIVGIVKVRVNHLGEIVAVGEY

SEQ ID NO: 10066 - protein, 143 aa, unidentified
  REGION 1..143: note = Description of Unknown:uncultivated organism sequence
AIFRDADGNLQEHVVSYFEATARAIQHLPVVDRDYKKAEGWQFLFTMKRNEYFVFPNEKTGFNPKEIDLLDPKNYAVISANLFRVQKLATKNYFFRHHLETNVETPKELSGITYKSQLGLKGIIGIVKVRVNNIGQIVAIGEY

SEQ ID NO: 10067 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISSSNYYFRHHLETTVDTNNALNGTTWKHVQSLKALENIIKVRVNNIGQIVAVGEY

SEQ ID NO: 10068 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAVISDNLFRVQKITTKDYFFRHHLETSVENNKSLCDITWKRITSLNKLQGIVKVRVNNIGQIVAVGEY

SEQ ID NO: 10069 - protein, 143 aa, unidentified
  REGION 1..143: note = Description of Unknown:uncultivated organism sequence
AIFTDSEGNLQEHVVSFYEATAMAILGYPVVDRQYNKGLGWKFLFSMKQNEYFVFPNEAEGFDPNEIDLTDESNAAIISRNLFRVQKFSKGDYFFRHHLETNVETNLKLKNVTWKRITRLNDLIGVVKVRVDHIGRIVYVGEY

SEQ ID NO: 10070 - protein, 143 aa, unidentified
  REGION 1..143: note = Description of Unknown:uncultivated organism sequence
AIFRDADGNLQEHVVSYFEATARAIQHLPIVDRDYKKAEGWQFLFTMKRNEYFVFPNEKTGFNPKEIDLLDPKNYAVISANLFRVQKLATKDYFFRHHLETSVKEEKLLFDITWKRITSLNKLQGIVKVRVNNIGQIVAIGEY

SEQ ID NO: 10071 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEVDLLDSKNYAVISDNLFRVQKLATKDYFFRHHLETSVENNKSLCDITWKRITSLNKLQGIVKVRVNNIGQIVAVGEY

SEQ ID NO: 10072 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETKVDDNNALKGTTWIRIRSLPALENIIKVRVNNIGQIVAVGEY

SEQ ID NO: 10073 - protein, 142 aa, unidentified
  REGION 1..142: note = Description of Unknown:uncultivated organism sequence
AIFRDKDGNLQEHIVSFFEATERAQQQLPIVDYEYNKHLGWQFLFTMKRNEYFVFPNEKTGFDPNEVDLLDPNNAAEISKNLFRVQKLTTKDYFFRHHLETNVETPKELLGTTYARLSLKGIVGIVKVRVNHLGEIVAVGEY

SEQ ID NO: 10074 - protein, 151 aa, unidentified
  REGION 1..151: note = Description of Unknown:uncultivated organism sequence
AIFRDANGNLQEHIVSYFEATARAIQHLPIVDRNYSKDEGWQFLFTMKRNEYFVFPNEKTGFDPKEIDLLDPKNYAEISKNLFRVQTMSKVQYGNSFVRDYKFRHHLETTLNDNKNLRDITYKQFKSLNFANSIIKVRVNNIGQIVAVGEY

SEQ ID NO: 10075 - protein, 143 aa, unidentified
  REGION 1..143: note = Description of Unknown:uncultivated organism sequence
AIFRDADGNLQEHMVSFYEATARAIQHLPIIDKEYNKDLGWQFLFTMKQNEYFVFPNEETGFNPKEIDLLNPKNYALISPNLFRVQKLSSKDYVFRHHLETKVEYNKELFGVIWKRIKSLGKIKDIVKVRINQIGKIEDLGEY

SEQ ID NO: 10076 - protein, 143 aa, unidentified
  REGION 1..143: note = Description of Unknown:uncultivated organism sequence
AIYKDADGNITEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNNIGQIVAVGEY

SEQ ID NO: 10077 - protein, 143 aa, unidentified
  REGION 1..143: note = Description of Unknown:uncultivated organism sequence
AIFRDAEGNLQEHVVSFYEATARAIQHLPVIDRDYNKAVGWQFLFTMKQNEYFVFPNAETGFDPKEIDLLDPKNYAAISPNLFRVQKVSKKNYMFRHHLETTVEEKKELQGFTWKNIRSLGGIDKLVKVRVNHLGQIVSVGEY

SEQ ID NO: 10078 - protein, 143 aa, unidentified
  REGION 1..143: note = Description of Unknown:uncultivated organism sequence
AIFRDANGNLQEHIVSYFEATARAIQHLPIVDRNYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 10079 - protein, 143 aa, unidentified
  REGION 1..143: note = Description of Unknown:uncultivated organism sequence
AVFRDETGKLQECIVPFLKVTERKAQDLPAIDKDYRKADGWTFEFTMKQNELFVFPNEETGFDPSEIDLLNPDNYALISPNLYRVQKLAAHDYYFRHHLETTVEDKETLKNISFKRIMSLAKLENIVKVRVNHIGQIVEIGEY

SEQ ID NO: 10080 - protein, 143 aa, unidentified
  REGION 1..143: note = Description of Unknown:uncultivated organism sequence
AIFCDIEGQIQEHLVSFYEATARAIQHLPVVDRNFNKDKDWQFMFTMKQNEYFVFPNKETGFDPKEIDLLNPKNYAAISPNLYRVQKLSSKYYVFRHHLETTVDDKKELLGITWKRIRSLDNLRDIVKVRINHLGQIVNVGEY

SEQ ID NO: 10081 - protein, 151 aa, unidentified
  REGION 1..151: note = Description of Unknown:uncultivated organism sequence
AIFRDANGNLQEHVVSYFEATARAIQHLPIVDRDYNKDEGWQFLFTMKRNEYFVFPNEKTGFDPKEVDLLDPKNYAEISENLFRVQTMSKLQYGNSFVRDYKFRHHLETTLNDNKELRDITYKQFKSLNFADTIVKVRVNNIGQIVAVGEY

SEQ ID NO: 10082 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETNVDDNNALKGTTWIRITSLKALENVIKVRVNNIGQIVAVGEY

SEQ ID NO: 10083 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISPGDYFFRHHLETTVDANNALKGTTWIRIRSLPALENIIKVRVNDIGQIVAVGEY

SEQ ID NO: 10084 - protein, 143 aa, unidentified
  REGION 1..143: note = Description of Unknown:uncultivated organism sequence
AIYKDADGNIKEQAVSFYIATNRVIHKQPAVDRNFNADKGWKFLFSIKKNEYFVFPNEKTGFNPAEIDLLNPDNNKIISPNLFRVQKISSSNYYFRHHLETTVDANNALNGTTWKHVQSLKALENIIKVRVNNIGQIVAVGEY

SEQ ID NO: 10085 - protein, 143 aa, unidentified
  REGION 1..143: note = Description of Unknown:uncultivated organism sequence
AIFRDANGNLQEHIVSYFEATARAIQHLPIVDRDYKKAEGWQFLFTMKRNEYFVFPNEKTGFDPKEIDLLDPKNYAEISANLFRVQKLATKDFFFRHHLETSVKEEKLLFDITWKRCRSLKELQGIVKVRINNIGQIVAVGEY

SEQ ID NO: 10086 - protein, 149 aa, unidentified
  REGION 1..149: note = Description of Unknown:uncultivated organism sequence
AIFRDSDGNLQEHMVSFYEATARAIQHLPIINREYNKDLGWQFLFTMKQNEYFVFPNEQTGFNPKEIDLLDPKNYALISPNLFRVQTMSKVMYGNNIVRDYKFRHHLETTVTRDLKDVTYKQYKNLSFANYIVKVRINHLGQIVSVGEY

SEQ ID NO: 10087 - protein, 143 aa, unidentified
  REGION 1..143: note = Description of Unknown:uncultivated organism sequence
AIFRDADGNLQEHVVSYFEATARAIQHLPIVDRDYKKAEGWQFLFTMKRNEYFVFPNEKTGFNPKEIDLLDSKNYAMISANLFRVQKLATKDYFFRHHLETSVKEEKLLFDITWKRITSLNKLQGIVKVRVNNIGQIVAIGEY

SEQ ID NO: 10088 - protein, 143 aa, unidentified
  REGION 1..143: note = Description of Unknown:uncultivated organism sequence
AIFRDAEGNLQEHMVSFYEATARAIQHLPIIDKEYNKDLGWQFLFTMKQNEYFVFPNEETGFNPKEIDLLDPQNYALISPNLFRVQKLSSKDYFFRHHLETKVEYNKELSGITWKRINTLSKIKDIVKVRINPVGQIVSVGEY

SEQ ID NO: 10089 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNENTGFNPAEIDLLNPDNNKIISPNLFRVQKISPGDYFFRHHLETTVDANNALKGTTWIRITSLKALENVIKVRVNNIGQIVTVGEY

SEQ ID NO: 10090 - protein, 142 aa, unidentified
  REGION 1..142: note = Description of Unknown:uncultivated organism sequence
AIYRDADGNLQENVVSFYEATMRANMGMPIIDKDYKKAEGWQFLFTMKQNEYFVFPNEESGFNPNDINLFNADNYAEISKNLFRVQKLATKDYFFRHHLETTVIDSNILKGITWKRCNLSSIKDIVKVRVNHIGQIVAVGEY

SEQ ID NO: 10091 - protein, 143 aa, unidentified
  REGION 1..143: note = Description of Unknown:uncultivated organism sequence
AIYRDGKGNLQEKVVSFYEATSRVALGLPIIDKAYKSSEGWNFLFSMKQNEYFVFPNEEIGFNPSEIDLTDAENYALISPNLFRVQKLTSKDYVFRHHLETIVDDKKELHGITWKRLSSLNNLDKIVKVRVNHIGQIVFVGEY

SEQ ID NO: 10092 - protein, 143 aa, unidentified
  REGION 1..143: note = Description of Unknown:uncultivated organism sequence
AIYEDEEGKWHEKVVSFNEAASRAIQKLPIIDKDFNKELGWVFQFTMKQNEMFVFPDKESGFDPLAIDLKDPANKTLISKHLYRVQKLSSCYYLFRHHLETNVEEKKELQEVAWKRIQTINNLRGIIKVRINHIGQIIDIGEY

SEQ ID NO: 10093 - protein, 160 aa, unidentified
  REGION 1..160: note = Description of Unknown:uncultivated organism sequence
VIYRVPQKGKDGKLKYDKYGNLEYEIVDIVVPFYEAVRRKSEGLDVVDKNLNKEAGWEFLFSMKQNEYFVFPNEKTGFDPTKIELTDHKNYSAISPNLYRVQKFSQGYYLFRHHLETTVKNESKEMKDILYKRITSLKQFENMVKVRVNHIGEIVDVGEK

SEQ ID NO: 10094 - protein, 142 aa, unidentified
  REGION 1..142: note = Description of Unknown:uncultivated organism sequence
AIFRDKDGNLQEHIVSFFEATERGQQQLPIVDYEYNKHLGWQFLFTMKRNEYFVFPNEKTGFDPNEVDLLDPNNAAEISKNLFRVQKLTTKDYFFRHHLETNVETPKELLGTTYARLSLKGIVGIVKVRVNHLGEIVAVGEY

SEQ ID NO: 10095 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNEKTGFNPAEIDLLNPDNNKIISPNLFRVQKISSSNYHFRHHLETNVDDNNALKGTTWIRIRSLPALENIIKVRVNNIGQIVAVGEY

SEQ ID NO: 10096 - protein, 143 aa, unidentified
  REGION 1..143: note = Description of Unknown:uncultivated organism sequence
AIYEDEEGKWHEKVVSFNEAASRAIQKFPIIDKDFNKELGWVFQFTMKQNEMFVFPDKESGFDPLAIDLKDPANKTLISKHLYRVQKLSSCYYLFRHHLETNVEEKKELQEVAWKRIQTINNLRGIIKVRINHIGQIIDVGEY

SEQ ID NO: 10097 - protein, 143 aa, unidentified
  REGION 1..143: note = Description of Unknown:uncultivated organism sequence
AIYEDEEGKWHEKVVSFNEAASRSIQKLPIIDKDFNKELGWVFQFTMKQNEMFVFPDKEAGFDPLAIDLKDPANKSLISKHLYRIQKISSGDYYFRHHLETNVEENKEVKGITWKRITSLSPLQGIIKVRINHIGQIIDIGEY

SEQ ID NO: 10098 - protein, 143 aa, unidentified
  REGION 1..143: note = Description of Unknown:uncultivated organism sequence
AIFRDANGNLQEHVVSYFEATARAIQHLPIVDRDYNKDEGWQFLFTMKRNEYFVFPNEKTGFDPKEIDLLDPKNYAVISANLFRVQKLATKNYFFRHHLETNVETPKELSGITYKSQLGLKGIAGIVKVRVNNIGQIVAVGEY

SEQ ID NO: 10099 - protein, 143 aa, unidentified
  REGION 1..143: note = Description of Unknown:uncultivated organism sequence
AIYEDEEGKWHEKVVSFNEAASRAIQKLPIIDKDFNKELGWVFQFTMKQNEMFVFPDKESGFDPLAIDLKDPANKSLISKHLYRIQKISSGDYYFRHHLETNVEENKEVKGITWKRIRSVSSLQGIIKVRVNHIGQIIDVGEY

SEQ ID NO: 10100 - protein, 143 aa, unidentified
  REGION 1..143: note = Description of Unknown:uncultivated organism sequence
AIYKDADGNIKEQAVPFYIATNRVIHKQPAVDRNFNADKGWKFLFSIKKNEYFVFPNENTGFNPAEIDLLNPDNNKIISPNLFRVQKISPGDYFFRHHLETTVDANNALKGTTWIRIRSLPALENIIKVRVNNIGQIVAVGEY

SEQ ID NO: 10101 - protein, 143 aa, unidentified
  REGION 1..143: note = Description of Unknown:uncultivated organism sequence
AIFRDADGNLQEHVVSYFEATARAIQHLPIVDRDYKKAEGWQFLFTMKRNEYFVFPNEKTGFNPKEIDLLDPKNYAVISANLFRVQKLATKDYFFRHHLETSVKEEKLLFDITWKRCRSPKELQGTIKVRVNNIGQIVAIGEY

SEQ ID NO: 10102 - protein, 142 aa, unidentified
  REGION 1..142: note = Description of Unknown:uncultivated organism sequence
AIFRDKDGNLQEHVVSYFEATERAQQQLPIVDYEYNKHLGWQFLFTMKRNEYFVFPNEKTGFDPNEVDLLDQKNAAEISKNLFRVQKLATKDYFFRHHLETNVDTPKELSGITYARLSLKGIVGIVKVRVNHLGEIVAVGEY

SEQ ID NO: 10103 - protein, 143 aa, unidentified
  REGION 1..143: note = Description of Unknown:uncultivated organism sequence
AVFRDAAGNLQEHVVSFYEATTRAIMGYPIVDKDYNSDEGWKFLFSMKQNEYFVFPNPKTGFNPQEIDLLDEKNMPLVSPNLYRVQKFTTGDYVFRHHLETNVESDNVLRDVTWKRIRSIKELESIVKVRVNHIGIIVAVGEY

SEQ ID NO: 10104 - protein, 143 aa, unidentified
  REGION 1..143: note = Description of Unknown:uncultivated organism sequence
AIFVDSEGNWHEHVVSFFEATASAMLGLPIVDKNYKREEGWKFLFSMKQNEYFVFPNEKTGFVPKEIDLTDPKNYPLISPNLYRVQKFSSLFYIFRHHLETNVEEPNALRDTTWKSIRSVKNLENVIKVRVNHIGCIVSVGEY

SEQ ID NO: 10105 - protein, 143 aa, unidentified
  REGION 1..143: note = Description of Unknown:uncultivated organism sequence
AVFRDSEGKLQEHVVSFYEATTRAIMGYPIVDKEYKRSDGWQFLFSMKQNEYFVFPNEKTGFNPQEMDLLDADNYAIISPNLYRVQKFTDGDYFFRHHLETSVENENSLKGVTWKRITSVHNLSGIIKVRVNHIGRIVSVGEY

SEQ ID NO: 10106 - protein, 143 aa, unidentified
  REGION 1..143: note = Description of Unknown:uncultivated organism sequence
AVFKDAEGRLREHVVSFYEATTRAIMGYPIVDREYKRSEGWQFLFSMKQNEYFVFPNEKTGFNPQEIDLLDVGNYPLISPNLYRVQKFSEGDYFFRHHLETSVESENALRDVTWIRVRAIQYLNGIVKVRVNHIGKIVSVGEY

SEQ ID NO: 10107 - protein, 143 aa, unidentified
  REGION 1..143: note = Description of Unknown:uncultivated organism sequence
AIYQDTDGKLQQRIVSFYEATTRALMGLPIVDKEYRQSEGWQFLFSMKQNECFVFPNKDSISNPKDVNLMNPKNFALISPNLYRVQKITDGDYFFRHHLETNVETENKLKGITWLRITSVQNLEGVVKVRINHIGDIVSIGEY

SEQ ID NO: 10108 - protein, 143 aa, unidentified
  REGION 1..143: note = Description of Unknown:uncultivated organism sequence
AIFIDAEGNWHEHVVSFYEATACAMLGLPIIDKNFKSEEGWKFLFSMKQNEYFVFPKEKTGFVPTEIDLTDPENYAQISPNLYRVQKFSSSFYVFRNHLETNVEEPTMLKDTTWKSIRSIRNLDGVVKVRVNHIGEIVEVGEY

SEQ ID NO: 10109 - protein, 143 aa, unidentified
  REGION 1..143: note = Description of Unknown:uncultivated organism sequence
AIFVDAEGNWHEHVVSFYEATASALLGMPIVDKNYKNEEGWKFMFSMKQNEYFVFPNEKTGFIPAETDLKNPDNYHLISPNLYRVQKFSSSFYVFRHHLETNVEEPAELRNTTWKRIQTIKYLEGIVKVRVNHIGEIVAVGEY

SEQ ID NO: 10110 - protein, 143 aa, unidentified
  REGION 1..143: note = Description of Unknown:uncultivated organism sequence
AIFEDKDGILQEHVVSFFEATERKMQHLQVVDRDYNSEYGWRFLFSMKQDEYFVFPNKVTGFNPADYDLMDSKNYALISPNLFRVQAISVGDYYFRHHLETNVDKNLSLKDITWKRIRNANDLKGIVKVRLDHLGTIVNVGEY

SEQ ID NO: 10111 - protein, 143 aa, unidentified
  REGION 1..143: note = Description of Unknown:uncultivated organism sequence
AIFVDSEGNWHEHVVSFFEATTSALLGLPIVDKNYKNEEGWKFLFSMKQNEYFVFPNERTGFVPSEIDLMDAKNYPLISPNLYRVQKFSSLFYIFRHHLETNVEEPNELRDTTWKSIRSVKSLSGVIKVRVNHIGAIVAIGEY

SEQ ID NO: 10112 - protein, 143 aa, unidentified
  REGION 1..143: note = Description of Unknown:uncultivated organism sequence
AVFRDANGKLQEHVVSFYEATTRATLGYPIVDKDYKRSEGWEFLFSMKQNECFVFSNEETGFNPQDINLLDANNWSQISPNLYRVQKFTTGDYVFRHHLETNVESENALRDITWKRIRAIQNLDGIIKVRLNHLGNIVAVGEY

SEQ ID NO: 10113 - protein, 143 aa, unidentified
  REGION 1..143: note = Description of Unknown:uncultivated organism sequence
AVFRDTEGKFQEHVVSFYEATTRAILDYPIVDKDYKRSEGWEFLFSMKQNEYFVFPNEKTGFKPQKIDLLNADNWGIISPNLYRVQKFTTGDYCFRHHLETNVESENALRDITWKRIRSIQDLDGIVKVRLNHLGNIVAVGEY

SEQ ID NO: 10114 - protein, 141 aa, unidentified
  REGION 1..141: note = Description of Unknown:uncultivated organism sequence
AVFRDASGNLHERVVSFYEATTRAMMGYPIIDKDYKQAEGWQFLFSMKQNEYFVFPSDGFNPSEIDLTDPQNYSLISPNLYRVQKFSEGDYFFRHHLETTVETDNSLKNITWKRINSVKSLEGIVKVRVDHIGRIVSVGEY

SEQ ID NO: 10115 - protein, 143 aa, unidentified
  REGION 1..143: note = Description of Unknown:uncultivated organism sequence
AIFVDSEGNWHEHVVSFFEATASAMLGLPIVDKNYKREEGWKFLFSMKQNEYFVFPNEKTGFVPKEIDLADPKNYPLISPNLYRVQKFSSSFYVFRHHLETSVEEPAELRDTTWKRIQTIKYLDGIVKVRINNIGVIVSVGEY

SEQ ID NO: 10116 - protein, 143 aa, unidentified
  REGION 1..143: note = Description of Unknown:uncultivated organism sequence
AIFADEQGHLQEHIVSFYEANSRAIQGLPIIEKDYQAELGWKFLFTMKQNEYFVFPDIENGFNPKEIDLTNVENYSIISPHLFRVQKLSSKYYVFRHHLETTVEDKSTLQEITWKRITAIDKLANIVKVRVNHIGQIVSVGEY

SEQ ID NO: 10117 - protein, 143 aa, unidentified
  REGION 1..143: note = Description of Unknown:uncultivated organism sequence
AIFMDEKGGLHEHMVSFYEASTRAIMGLPIIDKSFNQDIAWKFLFSMKQNEYFVFPNEETGFSPHEIDLTDQNNYSLISPNLFRVQKISNGDYYFRHHLETNVEEVKELRNITWKRIRTIKELDGIVKVRINHLGIIVSVGEY

SEQ ID NO: 10118 - protein, 143 aa, unidentified
  REGION 1..143: note = Description of Unknown:uncultivated organism sequence
AIFVDTEGNWHEHVVSFFEATTSALLGLPIIDKNYKREEGWKFLFSMKQNEYFVFPDEKTGFIPSEIDLMDSKNYPLISPNLYRVQKFSSSFYVFRHHLETNVDESNELKETTWKRITSIKGLEGAIKVRINHIGVIIAIGEY

SEQ ID NO: 10119 - protein, 151 aa, unidentified
  REGION 1..151: note = Description of Unknown:uncultivated organism sequence
AIYRDADGNLQDVGVSFLEATTRKALGLPVVDTDYNAALGWKFLFSMKQNEYFIFPDVEHGFDPSAIDLYDPNNKAEISKRLYRVQKLSRVDYGKQVVREYVFRHHLETTVEETKELKKITFKNIKSLAPLEGIIKVRVNHLGDILPSKEN

SEQ ID NO: 10120 - protein, 143 aa, unidentified
  REGION 1..143: note = Description of Unknown:uncultivated organism sequence
AIFVDSNGIWQEHVVSFFEATASALLGMPIVDKSYKSEEGWKFLFSMKQNEYFVFPNKETGFNPSEIDLMDESNYPIISQNLYRVQKFSSSYYVFRHHLETNVEEQNILKGTTWKRITSIKHLEGIVKVRVNHIGRIVAIGEY

SEQ ID NO: 10121 - protein, 143 aa, unidentified
  REGION 1..143: note = Description of Unknown:uncultivated organism sequence
AIFVDEEGNWHEHVVSFYEATASALLGVPIVDKDYKREEGWKFLFSMKQNEYFVFPNEKTGFVPSEIDLTNPDNYHLISPNLYRVQKFSSSDYMFRHHLETNVDESNELKGFTWKRITSLKNLEGVVKVRVNHIGQIVNVGEY

SEQ ID NO: 10122 - protein, 143 aa, unidentified
  REGION 1..143: note = Description of Unknown:uncultivated organism sequence
AIFIDEDGNWHEHVVSFYEATASALLGLPIVDKDYKREEGWKFLFSMKQNEYFVFPNEKSGFVPSEIDLTAPENYHLISPNLYRVQKFSSSFYVFRHHLETNVDESNELKDLTWKRITSIKNLEGIVKVRVNHIGQIVTVGEY

SEQ ID NO: 10123 - protein, 141 aa, unidentified
  REGION 1..141: note = Description of Unknown:uncultivated organism sequence
AIFRDAEGKLQEHIVSFYEATMRANQGWPIVDKEYNQAEGWEFLFTMKQNEYFVFPDKDFCPSEYDLMNPANYAFISPHLFRVQKLATKDYFFRHHLETTVEDKNELRNMTWKRIRNCDGLKGIVKVRVNHIGQIVAVGEY

SEQ ID NO: 10124 - protein, 143 aa, unidentified
  REGION 1..143: note = Description of Unknown:uncultivated organism sequence
AVFRDAEGKMQEHVVSFYEATTRAIMGYPVVDREFKRSEGWQFLFSMKQNEYFVFPNEKTGFNPQEIDLLDADNYATISPNLYRVQKFSEGDYFFRHHLETNVESENALRDITWIRVRSIQYLEGIVKVRVNHIGKIVSVGEY

SEQ ID NO: 10125 - protein, 143 aa, unidentified
  REGION 1..143: note = Description of Unknown:uncultivated organism sequence
AIFVDDEGNWHEHVVSFYEATASALLGLPIVDKNYKSEEGWKFLFSMKQNEYFVFPNEKTGFVPSEIDLTDPKNYSLISPHLYRVQKFSSLFYIFRHHLETNVEEPNELRDMTWKSIRSVKNLNGAIKVRVNHIGSIVAVGEY

SEQ ID NO: 10126 - protein, 143 aa, unidentified
  REGION 1..143: note = Description of Unknown:uncultivated organism sequence
AIFIDAEGNWHEHVVSFYEATASAMLGLPIIDKNFKSEEGWKFLFSMKQNEYFVFPNEKTGFVPTEIDLTDPKNYAQISPNLYRVQKFSSSFYVFRNHLETNVEEIKEQKGMSWFWVTSIKKLQGAVKVRINHLGNIVSIGEY

SEQ ID NO: 10127 - protein, 143 aa, unidentified
  REGION 1..143: note = Description of Unknown:uncultivated organism sequence
AVFRDKEGKLQEHVVSFYEATTRAILGYPIVDKEYRHSEGWEFLFSMKQNEYFVFPNEKTGFKPQEIDLLNANNWGIISPNLYRVQKFTTGDYFFRHHLETNVESDNALRDITWKRIRSIQDLDGIVKVRLNHLGSIVTVGEY

SEQ ID NO: 10128 - protein, 143 aa, unidentified
  REGION 1..143: note = Description of Unknown:uncultivated organism sequence
AVYRDADGKLQENVVSFYEATARAIMGFPIVDKDFKQSEGWTFLFSMKQNEYFVFPNPKTGFVPSEINLMDPNNYRLISPNLYRVQKFSDGDFFFRHHLETNVDQENALKDVTWKRITAIKNLEGVVKVRVNHIGQIVSVGEY

SEQ ID NO: 10129 - protein, 143 aa, unidentified
  REGION 1..143: note = Description of Unknown:uncultivated organism sequence
AIFVDANGDWHEHVVSFFEAATNALLGLPIVDKDYKKEEGWKFLFSMKQNECFVFPNPKTGFVPSEINLMDLNNYRLISPNLYRVQKFSSLFYVFRHHLETNVEEPKELRDVTWKSIRSVKNLEGIVKVRINHIGQIVSVGEY

SEQ ID NO: 10130 - protein, 143 aa, unidentified
  REGION 1..143: note = Description of Unknown:uncultivated organism sequence
SIFIDNDGNWHEHVVSFYEATTRAILGYPIVDKNYMCEEGWKFLFSMKQNEYFVFPNEQTGFDPLDIDLLDPQNYPLISPNLFRVQKFSSLFYVFRHHLETDVEEPKELKDITWKSIRSVKNLNGIVKVRVNHIGNIVSIGEY

SEQ ID NO: 10131 - protein, 143 aa, unidentified
  REGION 1..143: note = Description of Unknown:uncultivated organism sequence
AIFIDDKGSWHEHIVSFYEATVNALLGLPIVDKDYKKEEGWHFLFSMKQNEYFVFPNEKTGFMPSEIDLLNPDNYSLISPNLYRVQKFSSLFYVFRHHLETNVDEPKELRDTTWKSIRSIKNFEGVVKVRVNHLGLIVAIGEY

SEQ ID NO: 10132 - protein, 143 aa, unidentified
  REGION 1..143: note = Description of Unknown:uncultivated organism sequence
AVFRDAEGKMQEHVVSFYEATTRAIMGYPVVDREFKRSEGWQFLFSMKQNEYFVFPNEKTGFNPQEIDLLDADNYATISPNLYRVQKFTDGDYFFRHHLETNVENESSLKGIAWKRINSVQSLNGVVKVRVNHIGKIVSVGEY

SEQ ID NO: 10133 - protein, 143 aa, unidentified
  REGION 1..143: note = Description of Unknown:uncultivated organism sequence
AIFIDSEGCWHEHVVSFFEATASALLGLPIVDKDYKREEGWKFLFSMKQNEYFVLPNEKTGFIPSEIDLMDPKNYALISPNLYRVQKFSSSFYVFRHHLETNVDESNELKETTWKRIQTIKYLDGIVKVRLNHLGNIVAIGEY

SEQ ID NO: 10134 - protein, 143 aa, unidentified
  REGION 1..143: note = Description of Unknown:uncultivated organism sequence
AVFRDAEGKMQEHVVSFYEATTRAIMGYPVVDREFKRSEGWQFLFSMKQNEYFVFPNEKTGFNPQEIDLLDADNYATISPNLYRVQKFTDGDYFFRHHLETNVENESSLKGITWKRINSVQSLNGVVKVRVNHIGKIVSVGEY

SEQ ID NO: 10135 - protein, 141 aa, unidentified
  REGION 1..141: note = Description of Unknown:uncultivated organism sequence
AVFRDASGNLHERVVSFYEATTRAMMGYPIIDKDYKQAEGWQFLFSMKQNEYFVFPSDGFNPSEIDLTDPQNYSLISPNLYRVQKFSEGDYFFRHHLETTVETDNALRDITWKRIRSIDGIDGAIKVRVDHIGRIVSVGEY

SEQ ID NO: 10136 - protein, 143 aa, unidentified
  REGION 1..143: note = Description of Unknown:uncultivated organism sequence
AIFVDNDGNWHEHVVSFYEATASALLGLPIVDKNYKSEEGWKFLFSMKQNEYFVFPNEKTGFVPSEIDLTDPKNYSLISPNLYRVQKFSSLFYIFRHHLETNVEEPNELRDMTWKSIRSVKNLNGAIKVRVNHIGSIVAVGEY

SEQ ID NO: 10137 - protein, 143 aa, unidentified
  REGION 1..143: note = Description of Unknown:uncultivated organism sequence
AIFVDTEGNWHEHVVSFFEATASALLGLPIVDKNYKSEEGWKFLFSMKQNEYFVFPNEKTGFIPSEIDLMDIKNYPLISPNLYRVQKFSSLFYIFRHHLETNVEEPNELKDTTWKRINSVKNLNGVIKVRVNHLGTIVAVGEY

SEQ ID NO: 10138 - protein, 143 aa, unidentified
  REGION 1..143: note = Description of Unknown:uncultivated organism sequence
AIFADSEGNWHEHVVSFFEATTSALLGLPIVDKNYNSEEGWKFLFSMKQNEYFVFPNEKTGFVPSEIDLMDPKNYSLISPNLYRVQKFSSSDYYFRHHLETNVEETKELRDITWKRITSLKYLEGAIKVRVNHIGSIVSVGEY

SEQ ID NO: 10139 - protein, 143 aa, unidentified
  REGION 1..143: note = Description of Unknown:uncultivated organism sequence
AIFVDEDGNWHEHVVSFFEATVNALQGLPIVDKNYKSEEGWKFLFSMKQNEYFVFPNEKTGFIPSEIDLLDPNNYPLISPNLYRVQKFSSLFYIFRHHLETNVEEPNDLRDTTWKSIRSVKNLDGAIKVRVNHIGAIVAVGEY

SEQ ID NO: 10140 - protein, 143 aa, unidentified
  REGION 1..143: note = Description of Unknown:uncultivated organism sequence
AIFIDAEGNWHEHVVSFYEATACAMLGLPIIDKNFKSEEGWKFLFSMKQNEYFVFPNEKTGFVPTEIDLTDPENYAQISPNLYRVQKFSSSFYVFRNHLETNVEEIKEQKGMSWFWVTSIKKLQGAVKVRINHLGNIVSIGEY

SEQ ID NO: 10141 - protein, 143 aa, unidentified
  REGION 1..143: note = Description of Unknown:uncultivated organism sequence
AIFIDAEGNWHEHVVSFYEATACAMLGLPIIDKNFKSEEGWKFLFSMKQNEYFVFPNEKTGFVPTEIDLTDPENYAQISPNLYRVQKFSSSFYVFRNHLETNVEEPTMLKDTTWKSIRSIRNLDGVVKVRVNHIGEIVEVGEY

SEQ ID NO: 10142 - protein, 143 aa, unidentified
  REGION 1..143: note = Description of Unknown:uncultivated organism sequence
AIFIDAEGNWHEHVVSFYEATASALLGLPIIDKNFKSEEGWKFLFSMKQNEYFVFPNEKTGFVPTEIDLTDPKNYAQISPNLYRVQKFSSSFYVFRNHLETNVEEIKEQKGMSWFWVTSIKKLQGAVKVRINHLGNIVSIGEY

SEQ ID NO: 10143 - protein, 143 aa, unidentified
  REGION 1..143: note = Description of Unknown:uncultivated organism sequence
AVFRDANGKLQEHVVSFYEATTRATLGYPIVDKNYNRSEGWEFLFSMKQNEYFVFPNEKTGFNPQNINLLDANNWRQISPNLYRVQKFTTGDYVFRHHLETNVESENALRDITWKRIRAIQNLDGIIKVRLNHLGNIVAVGEY

SEQ ID NO: 10144 - protein, 143 aa, unidentified
  REGION 1..143: note = Description of Unknown:uncultivated organism sequence
AIFIDSNGNLQEHIVTFYEATASALLGLPIVDKNYKSEEGWKFLFSMKQNEYFVFPNQETGFQPTEIDLKDPNNYALISQNLYRVQKFSSLYYVFRHHLETNVEETNALKGITWKRIQNLKSLMGIVKVRVNHLGMIVAVGEY

SEQ ID NO: 10145 - protein, 143 aa, unidentified
  REGION 1..143: note = Description of Unknown:uncultivated organism sequence
AVFRDASGKLQEHVVSFYEATTRAILGYPIVDKEYNRSEGWEFLFSMKQNEFFVFPNEKTGFNPQETDLMDANNWSAISPNLYRVQKFTTGDYFFRHHLETNVENSNNLKDITWKRINSANNLAGIVKVRLNHLGEIVAIGEY

SEQ ID NO: 10146 - protein, 143 aa, unidentified
  REGION 1..143: note = Description of Unknown:uncultivated organism sequence
AVFRDASGKLQEHVVSFYEATTRAILGYPIVDKEYNRSEGWEFLFSMKQNEYFVFPNEKTGFNPQETDLMDANNWSTISPNLYRVQKFTTGDYGVRHHLETNVESENVLRDITWKRIRSVQGLDGVVKVRLNHLGEIVAIGEY

SEQ ID NO: 10147 - protein, 143 aa, unidentified
  REGION 1..143: note = Description of Unknown:uncultivated organism sequence
AVFRDKEGKLQEHVVSFYEATTRAILGYPIVDKEYRHSEGWEFLFSMKQNEYFVFPNEKTGFKPQEMDLLNVNNWGKISPNLYRVQKFTTGDYVFRHNLETNVESENALRDITWKRIRSIQDLDGIIKVRLNHLGSIVAVGEY

SEQ ID NO: 10148 - protein, 143 aa, unidentified
  REGION 1..143: note = Description of Unknown:uncultivated organism sequence
AIFMDEKGGLHEHMVSFYEASTRAIMGLPIIDKSFNQDIAWKFLFSMKQNEYFVFPNEDTGFSPHEIDLTDQNNYSLISPNLFRVQKISNGDYYFRHHLETNVEEVKELRNITWKRIRTIKELDGIVKVRINHLGIIVSVGEY

SEQ ID NO: 10149 - protein, 143 aa, unidentified
  REGION 1..143: note = Description of Unknown:uncultivated organism sequence
AIFMDEKGVLHEHMVSFYEATTRAIMGLPIIDKSFNQDLGWKFLFSMKQNEYFVFPNEETGFSPHEIDLTDQNNYSLISPNLFRVQKISNGDYFFRHHLETNVEEVKELRNITWKRIRTIKELDGIVKVRINHLGIIVSVGEY

SEQ ID NO: 10150 - protein, 143 aa, unidentified
  REGION 1..143: note = Description of Unknown:uncultivated organism sequence
AVFRDANGKLQEHVVSFYEATTRATLGYPIVDKNYNRSEGWEFLFSMKQNEYFVFPNEKTGFNPQNINLLDANNWRQISPNLYRVQKFTTGDYVFRHHLETNVESENALRDFTWKRIRAIQNLDGIIKVRLNHLGNIVAVGEY

SEQ ID NO: 10151 - protein, 143 aa, unidentified
  REGION 1..143: note = Description of Unknown:uncultivated organism sequence
AVFRDAAGKLQEHVVSFYEATTRAILGYPIVDKEYRRSEGWKFLFSMKQNEYFVFPNEKTSFKPQEIDLLNADNWSIISPNLYRVQKFTTGDYVFRHHLETNVESEIALRDITWKRIRAIQNLEGIVKVRLNHLGNIVAVGEY

SEQ ID NO: 10152 - protein, 143 aa, unidentified
  REGION 1..143: note = Description of Unknown:uncultivated organism sequence
AVFRDAAGKLQEHVVSFYEATTRAILGYPIVDKEYRRSEGWEFLFSMKQNEYFVFPNEKTSFKPQEIDLLNADNWSIISPNLYRVQKFTTGDYVFRHHLETNVESEIALRDITWKRIRAIQNLEGIVKVRLNHLGNIVAVGEY

SEQ ID NO: 10153 - protein, 143 aa, unidentified
  REGION 1..143: note = Description of Unknown:uncultivated organism sequence
AVFRDASGKLQEHVVSFYEATTRAILGYPIVDKEYNRSEGWEFLFSMKQNEYFVFPNEKTGFNPQETDLMDANNWSAISPNLYRVQKFTTGDYFFRHHLETNVENSNNLKDITWKRINSANNLAGIVKVRLNHLGEIVAIGEY

SEQ ID NO: 10154 - protein, 143 aa, unidentified
  REGION 1..143: note = Description of Unknown:uncultivated organism sequence
AIFEDADGNLQEHVVSFFEVTERVRQHLPIVDRNYNSANGWKFLFSMKQDEYFVFPNLKDNFNPIDYDLKDKKNYSLISPNLFRVQKMGKGDYVFRHHLETNVEQNKDLKDITWKRYRTPNGLKGAIKVRVNHIGDIVDVGEY

SEQ ID NO: 10155 - protein, 143 aa, unidentified
  REGION 1..143: note = Description of Unknown:uncultivated organism sequence
AVFRDANGKLQEHVVSFYEATTRATLGYPIVDKDYNRSEGWEFRFSMKQNEYFVFPNEKTGFNPQDVNLLDASNWSRISPNLYRVQKFATGDYVFRHHLETNVESENALRDITWKRIRAIQNLDGIVKVRLNHLGNIVAVGEY

SEQ ID NO: 10156 - protein, 143 aa, unidentified
  REGION 1..143: note = Description of Unknown:uncultivated organism sequence
AIFVDSEGNWHEHVVSFFEATTSALLGLPIVDKNYKREEGWKFLFSMKQNEYFVFPNEKTGFVPFEIDLMDPKNYALISPNLYRVQKFSSSFYVFRHHLETNVDESNELKETTWKRITSVKGLERVIKVRINHLGNVVVVGEY

SEQ ID NO: 10157 - protein, 143 aa, unidentified
  REGION 1..143: note = Description of Unknown:uncultivated organism sequence
AIFIDAEGNWHEHVVSFYEATASAMLGLPIIDKNFKSEEGWKFLFSMKQNEYFVFPNEKTGFVPTEIDLTDPENYAQISPNLYRVQKFSSSFYVFRNHLETNVEEPTMLKDTTWKSIRSIRNLDGVVKVRVNHIGEIVEVGEY

SEQ ID NO: 10158 - protein, 139 aa, unidentified
  REGION 1..139: note = Description of Unknown:uncultivated organism sequence
AIFRDANGKLQEHIVSFYEATMRANQGWPIIDKEYNQTEGWEFLFSMKQNEYFVFPDKDFCPADYDLMNPDNYAIISPHLFRVQKLASKDYFFRHHLETTVEDKNELRDMTWKRIRNCDELQGIVKVRVNHIGQIVAVG

SEQ ID NO: 10159 - protein, 141 aa, unidentified
  REGION 1..141: note = Description of Unknown:uncultivated organism sequence
AIYRDAEGNLQENVVTFFEAASRVNLGLPIIDIGYNGDKGWQFLFSMKQNEYFVFPDEKTGFKPNEIDLLNSENYHLISPNLFRVQKLATKDYFFRHHLETTVDSDNKLKGITWLRLGINGIDNIIKVRINHLGQIVSVGE

SEQ ID NO: 10160 - protein, 160 aa, unidentified
  REGION 1..160: note = Description of Unknown:uncultivated organism sequence
VIYRVPQKGKDGKLKYDKDGNLEYEIVDIVVPFYEAVRRKSEGLDVVDKNLNKEAGWEFLFSMKQNEYFVFPNEKTGFDPTKIELNDPKNYSAISPNLFRVQKFSKGDYMFRHHLETTVKNESKEMKDILYKRITSLKQFENMVKVRVNHIGEIVDVGEK

SEQ ID NO: 10161 - protein, 160 aa, unidentified
  REGION 1..160: note = Description of Unknown:uncultivated organism sequence
VIYRVPQKGKDGKLKYDKDGNLEYEIVDIVVPFYEAVRRKSEGLDVVDKNLNKEAGWEFLFSMKQNEYFVFPNEKTGFDPTKIELNDPKNYSAISPNLFRVQKFSKGDYMFRHHLETTVKNESKEMKDILYKRIQNAKGLIGMVKVRVNHIEEIVDDKGL

SEQ ID NO: 10162 - protein, 160 aa, unidentified
  REGION 1..160: note = Description of Unknown:uncultivated organism sequence
VIYRVPQKGKDGKLKYDKDGNIEYEIVDIVVPFYEAVRRKSEGLDVIDKNLNKEEGWEFLFSMKQNEYFVFPNEETGFDPTKIDLKDPKNYSVISPNLFRVQKFSKGDYMFRHHLETTVKNESKEMKDILYKRIKSLKQFENMVKVRVNHIGEIVDDKGL

SEQ ID NO: 10163 - protein, 133 aa, unidentified
  REGION 1..133: note = Description of Unknown:uncultivated organism sequence
SNYMRDRKRLNKPDLRAGDKITAEGNIRLYDALVEKLGSSVYAGLSVKGQEPFLRGKREAFAELSREDQCKIIFEVLHLMQCNSVLSDFSSLGGVAHAGKNFSNKFVQDMDIKMIFQSPTGYYRRVVDLKEFV

SEQ ID NO: 10164 - protein, 138 aa, unidentified
  REGION 1..138: note = Description of Unknown:uncultivated organism sequence
VSYNEKRKNNKDAKVDETYDKISKTGNLTLYNALLDKLTSHPYINFSALQKQAEFLKEKRDVFCELSVENQCTLLLEILHLMQCNSTSSNLTLIGGGSRAGVLTCNKKLPETGECLLITQSPTGYYKNIVNLTAYYRQ

SEQ ID NO: 10165 - protein, 138 aa, unidentified
  REGION 1..138: note = Description of Unknown:uncultivated organism sequence
VSFIDKKENNKGAKVDVVYDKIDKTGNLMLYNTLLQKLQSQPYINLSALKTQIDFLEGKRDSFNMLSLEEQCSLLLEIMHLFQCNSTPANLKLIDGVSRAGVLTCNKKLSETGECLLITQSPTGYYKNIVNLTAFYQQ

SEQ ID NO: 10166 - protein, 138 aa, unidentified
  REGION 1..138: note = Description of Unknown:uncultivated organism sequence
SRFCEKNKKAEGRLTADDKHDGISKEKNLSFYRMLTSRLCTKPYVVLSIGKQAKKLRRFEPVFVELEAEKQCSVIMEIMHFFQCKSGTGDLSVLGGGKTLGVNTHSKTIDPDEEILLISQSPTGFYQNAISLTGFYKA

SEQ ID NO: 10167 - protein, 138 aa, unidentified
  REGION 1..138: note = Description of Unknown:uncultivated organism sequence
VSYLEKRKKNKAIEIDERYDKIDRKGNQMLYNTLVEKLMSRPYANISTLRKQSDFLVEKRDTFESLTLEEQCIVLNEILHLMQCNSALSNFELLKGVSKAGSLTCNKKLSANDECLLITQSPTGYYKDVKNLTSFYKQ

SEQ ID NO: 10168 - protein, 138 aa, unidentified
  REGION 1..138: note = Description of Unknown:uncultivated organism sequence
VSYNEKRKNNKDSKVDETYDKISKTGNLTLYNALLDKLTSHPYINFSALQKQAEFLKEKRDVFCELSVENQCAVLLEILHLMQCNSAMSNFSLLSGNPTVGKLTCNKKLSETGECLLITQSPTGYYKNIVNLTAYYRQ

SEQ ID NO: 10169 - protein, 138 aa, unidentified
  REGION 1..138: note = Description of Unknown:uncultivated organism sequence
VSFLDKKKKNKDARVDVVYDKIDKTGNLMLYNALLQKLQTQPYINLSALKAQIGFLEESRCNFEILSIEEQCTLLSEVLHLLQCNSTFANLKLLGGVPSAGVLTCNKKLSETGECLLITQSPTGYYKNIVNLTAFYQQ

SEQ ID NO: 10170 - protein, 138 aa, unidentified
  REGION 1..138: note = Description of Unknown:uncultivated organism sequence
VSYNEKRKNNKDAKVDETYDNISKTGNLTLYNALLDKLTSHPYINFSALQKQAEFLKEKRDVFCELSVENQCTLLLEILHLMQCNSTSSNLTLIGGGSRAGVLTCNKKLSETGECLLITQSPTGYYKNIVNLTAYYRQ

SEQ ID NO: 10171 - protein, 134 aa, unidentified
  REGION 1..134: note = Description of Unknown:uncultivated organism sequence
SNHFKDVKKCNNKDLPVDEEKINARQNLALYDLLTEKLGSKTYAGLPCGGQANKLKSGRDKFEGLSLKDQCYVLMKVLEIMDCKNMGSDIRLVGGAANDGRNLINKFFQNSDVKIIFSSPTGYFRSVVDLKSFL

SEQ ID NO: 10172 - protein, 137 aa, unidentified
  REGION 1..137: note = Description of Unknown:uncultivated organism sequence
SRFCEKNKKAEGKLTADEQHDGLTKDKNLEFYRMLADRLCSAPYSALLGQQAPGLREKESVFAALAIEEQCSVIMEVMHFFQCNSVTSNLQTIGGVPTAGKILKSKKLSENEEILLIYQSPTGFYQKTISLTGFYKA

SEQ ID NO: 10173 - protein, 133 aa, unidentified
  REGION 1..133: note = Description of Unknown:uncultivated organism sequence
SNYMTDRKLLKRQDLPVGEKIKAEDNVRLYDALVEKLGSPVYRGLSIRKQAEFLKKSRERFISLSLEKQCVVIFEVLHLMQCNSVTADLTLLGGVPNAGSLVSSKFVQDNEMKIIYQSCTGYYREIIDFKRFL

SEQ ID NO: 10174 - protein, 133 aa, unidentified
  REGION 1..133: note = Description of Unknown:uncultivated organism sequence
SNYFRDKKKLNRSELPVGDKINGEDNLKLYDALIAKLSSKVYSGLNISGQAPMLSEKRDKFIELTLENQCKVLWEVLKLMQCNSTSSDFLLIGGSANTGIVVNNKNIQDQTVKMIYQSPTGYYRRVIDFSEFL

SEQ ID NO: 10175 - protein, 137 aa, unidentified
  REGION 1..137: note = Description of Unknown:uncultivated organism sequence
SRFCEKNKKAEGRLTADEQHDGLTKEKNLEFYRMLVKRLEEKPYCLLPMPDSTTLLKSKENVFVMLNIEEQCSVIMEIMHFFQCNSVESDLTLLGGKKAGKVRRSKTIDPDEEILLISQSPTGFYQKTVSLTGFYKA

SEQ ID NO: 10176 - protein, 137 aa, unidentified
  REGION 1..137: note = Description of Unknown:uncultivated organism sequence
SRFCEKNKKAEGRLTADEQHDGLTKEKNLEFYRMLVSRLCSAPYSALLGQQAPGLREKESVFAALAIEEQCSVIMEVMHFFQCNSVLSDLSGISGVSKAGLVRNNKKLSKNEEILLIYQSPTGFYQKTVSLTGFYKA

SEQ ID NO: 10177 - protein, 137 aa, unidentified
  REGION 1..137: note = Description of Unknown:uncultivated organism sequence
SRFCEKNKKAEGKLTADEQHDGLTKEKNLEFYRMLTDRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 10178 - protein, 137 aa, unidentified
  REGION 1..137: note = Description of Unknown:uncultivated organism sequence
SRFCEKNKKAEGKLTADEQHDGLTKEKNLEFYRMLVSRLCSAPYSALLGQQAPGLREKESVFAALAIEEQCSVIMEVMHFFQCNSVLSDLSGISGVSKAGLVRNNKKLSKNEEILLIYQSPTGFYQKTVSLTGFYKA

SEQ ID NO: 10179 - protein, 133 aa, unidentified
  REGION 1..133: note = Description of Unknown:uncultivated organism sequence
SNYMSDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 10180 - protein, 139 aa, unidentified
  REGION 1..139: note = Description of Unknown:uncultivated organism sequence
VSFVDKEKKDGKQLIPTAEFDGISKDDNLRLYDALIDKMSNTPYSNISSFALQTQFLNSKRNSFCELCEKDQIKVLLEVLHFLQCNPVLSNLKLIDGSPNSGLLRHSKNISQDEECLLITQSPTGYYKDTVNLTAYFDK

SEQ ID NO: 10181 - protein, 134 aa, unidentified
  REGION 1..134: note = Description of Unknown:uncultivated organism sequence
GNYMRDRKTFNNPQMPANEKITAENNLRLYDALVQKLSSSLYAGLAICGQVPFLKEKRPVFVSLSVEKQCCVLWEVLRLMQCNVGLSDFTLLGGVANAGVTTINKFIQDKNIKLIFQSPTGYYRTVVDVGRFLK

SEQ ID NO: 10182 - protein, 139 aa, unidentified
  REGION 1..139: note = Description of Unknown:uncultivated organism sequence
VSFVDKEKKEGKQLIPTVEFDGIAKDDNLKLYDALIDKMGSAPYSNISSFALQTKFLSSKRNSFGELCEKDQIKVLLEVLHFLQCNPVLSNLKLIDGSANSGSLLHSKKISQDEECLLITQSPTGYYRDTVNLTAYFDK

SEQ ID NO: 10183 - protein, 137 aa, unidentified
  REGION 1..137: note = Description of Unknown:uncultivated organism sequence
SRFCEKNKKAEGKLIADEQHDGLTKDKNLEFYRMLVKRLEEKPYCLLPMPDSTTLLKSKENVFVMLNIEEQCSVIMEIMHFFQCNSVESDLTLLGGKKTGMVRRSKTIDSDEEILLISQSPTGFYQKAISLTGFYKA

SEQ ID NO: 10184 - protein, 133 aa, unidentified
  REGION 1..133: note = Description of Unknown:uncultivated organism sequence
SNYMTDRKLLKRQDLPVGEKIKAEDNVRLYDALVEKLGSPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 10185 - protein, 133 aa, unidentified
  REGION 1..133: note = Description of Unknown:uncultivated organism sequence
SNYMRDRKRLNKPDLCAGDKITAECNIRLYDALVEKLGSSVYAGLSVKGQVPFLRGKREAFAELSREDQCKIIFEVLHLMQCNSVLSDFSSLGGVAHAGSILSNKFVQDMGIKMIFQSPTGYYRRVVDLKEFI

SEQ ID NO: 10186 - protein, 137 aa, unidentified
  REGION 1..137: note = Description of Unknown:uncultivated organism sequence
SRFCEKNKKAEGRLTADEQHDGLTKEKNLEFYRMLVSRLCSAPYSALLGQQAPGLREKESVFAALAIEEQCSVIMEVMHFFQCNSVTSNLQTIGGVPTAGKILKSKKLSENEEILLIYQSPTGFYQKTISLTGFYKA

SEQ ID NO: 10187 - protein, 133 aa, unidentified
  REGION 1..133: note = Description of Unknown:uncultivated organism sequence
SNYMRDRKKLNNPDLQAGKSITSEDNLFIYDALTQKLASPIYAGLSIKGQVSFLSQKRDAFVVLSLEEQCRVLFEILHLMQCKSVPADLTLLGGAARAGVILSNKFVQDVNIKMIYQSPTGYYRKVVNLKELL

SEQ ID NO: 10188 - protein, 133 aa, unidentified
  REGION 1..133: note = Description of Unknown:uncultivated organism sequence
SNYFRDKKKLNRSELPVGDKINAEDNLKLYDALIAKLSSKIFAGLKISGQAPMLSEKRDKFIELTLENQCKILWEVLKLMQCNSSLSDFSSMGGAANAGSIFVAKNIQDQSVKMIYQSPTGYYRRVVDFSEFL

SEQ ID NO: 10189 - protein, 137 aa, unidentified
  REGION 1..137: note = Description of Unknown:uncultivated organism sequence
SRFCEKNKKAEGRLTADEQHDGLTKEKNLEFYRMLVKRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 10190 - protein, 139 aa, unidentified
  REGION 1..139: note = Description of Unknown:uncultivated organism sequence
VSFRNKGKKWNVQIIPTVEFDGIAKEDNIRLYDVFVEKLLSTPYSNISSFRQQADLLQTNRNIFVELCEMDQIEVLAEVLHFMQCNSVLSKLTLIGGSPNSGKLLHSKNVSAEEEFLLITQSPTGYYRNTVDLTAFYQQ

SEQ ID NO: 10191 - protein, 139 aa, unidentified
  REGION 1..139: note = Description of Unknown:uncultivated organism sequence
VSFRNKGKKWNVQIIPTVEFDGITKEDNIRLYDVFVEKLLSTPYSNISSFRQQADLLQTNRNIFVELCEMDQIEVLAEVLHFMQCNSVLSKLTLIGGSPNSGKLLHSKNVSAEEEFLLITQSPTGYYRNTVDLTAFYQQ

SEQ ID NO: 10192 - protein, 134 aa, unidentified
  REGION 1..134: note = Description of Unknown:uncultivated organism sequence
SNYMRDRKTFNNPQMPANEKITAENNLRLYDALVQKLSSSLYAGLAICGQVPFLKEKRPVFASLSVEKQCCVLWEVLRLMQCNVGLSDFTLLGGVANAGVTTINKFIQDKNIKLIFQSPTGYYRTVVDVGRFLK

SEQ ID NO: 10193 - protein, 133 aa, unidentified
  REGION 1..133: note = Description of Unknown:uncultivated organism sequence
SNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFKRFL

SEQ ID NO: 10194 - protein, 138 aa, unidentified
  REGION 1..138: note = Description of Unknown:uncultivated organism sequence
VSYNEKRKKNKDVTVDETYDKISKTGNLTLYNALLNKLTSHPYINFSALQKQAEFLNEKWDVFCELSVENQCTLLLEILHLMQCNSTSSNLTLIGGGSRAGVLTCNKKLSENGECLLITQSPTGYYKNIVNLTAYYRQ

SEQ ID NO: 10195 - protein, 137 aa, unidentified
  REGION 1..137: note = Description of Unknown:uncultivated organism sequence
SRFCEKNKKAEGKLTADEQHDGLTKDKNLEFYRMLVKRLEEKPYCLLPMPDSTTLLKSKENVFVMLNIEEQCSVIMEIMHFFQCNSVESDLTLLDGKKTGMVRRSKTIDPDEEILLIYQSPTGFYQKTVSLTGFYKA

SEQ ID NO: 10196 - protein, 133 aa, unidentified
  REGION 1..133: note = Description of Unknown:uncultivated organism sequence
SNYMTDRKLLKRQDLPVGEKIKAEDNVRLYDALVEKLESPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 10197 - protein, 140 aa, unidentified
  REGION 1..140: note = Description of Unknown:uncultivated organism sequence
TNYFKDVEKYKNDYKNKNKDLPVKEEINARENLALYDLLTEKLGSKTYAGLSCGGRAKTLKAGRNKFEELSLEKQCYVLMEVLKFMTCNREESDITLVGGSKNAGKNTLNKKIDQESDVKIIFCSPTGYFRSVVDLKSFL

SEQ ID NO: 10198 - protein, 139 aa, unidentified
  REGION 1..139: note = Description of Unknown:uncultivated organism sequence
SAFIAKQKKMRESLVPTAEFDEITKENNMVLYDKLLEKISNAPYSNLPTFIQQSAFLEEKRERFGELSERDQISVLTEVLHFVQCNSVLSNLSILGGVQHAGLLLRSKKIASDEEFLLITQSPTGYYRSTVDLTAFYQQ

SEQ ID NO: 10199 - protein, 138 aa, unidentified
  REGION 1..138: note = Description of Unknown:uncultivated organism sequence
ISFMQKQKKLGVEFEPMLEIDLISAQMNLVLYDSFVNKLGNAPYGNLPMMENYYKLMCDGRDVFTAMNMKQQVILLSQILKLFQCNPVEADLTSIGGRSAGALRRSKKIALDEEFLLITQSPTGYYRDTVDLTAFYQQ

SEQ ID NO: 10200 - protein, 133 aa, unidentified
  REGION 1..133: note = Description of Unknown:uncultivated organism sequence
SNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVSSKFVQDNEMKIIYQSCTGYYREIIDFKRFL

SEQ ID NO: 10201 - protein, 137 aa, unidentified
  REGION 1..137: note = Description of Unknown:uncultivated organism sequence
SRFCEKNKKAEGRLTADEQHDGLTKEKNLEFYRMLTDRLCSAPYSALLGQQAPGLREKESVFMGLTIEAQCSVIMEVMHFFQCNSVTSNLQAIGGVPQAGKIYNNKKLSEYEEILLIYQSPTGFYQKTISLTGFYKA

SEQ ID NO: 10202 - protein, 137 aa, unidentified
  REGION 1..137: note = Description of Unknown:uncultivated organism sequence
SRFCEKNKKAEGRLIADEQHDGLTKDKNLEFYRMLVKRLEEKPYCLLPMPDSTTLLKSKENVFVMLNIEEQCSVIMEIMHFFQCNSVESDLTLLGGKKTGMVRRSKTIDPDEEMLLIYQSPTGFYQKAISLTGFYKA

SEQ ID NO: 10203 - protein, 137 aa, unidentified
  REGION 1..137: note = Description of Unknown:uncultivated organism sequence
SRFCEKNMKAEGRLTADEQHDGLTKEKNLEFYRMLADRLCSAPYSALLGQQAPGLREKESVFAALAIEEQCSVIMEVMHFFQCNSVLSDLSGISGVSKAGLVRNNKKLSKNEEILLIYQSPTGFYQKTISLTGFYKA

SEQ ID NO: 10204 - protein, 133 aa, unidentified
  REGION 1..133: note = Description of Unknown:uncultivated organism sequence
SNYMTDRKLLKRQDLPVGEKIKAEDNVRLYDALAEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFEKFL

SEQ ID NO: 10205 - protein, 133 aa, unidentified
  REGION 1..133: note = Description of Unknown:uncultivated organism sequence
SNYMTDRKLLKRQDLPVGEKIKAEDNVRLYDALVEKLESPVYRGLSIRKQAEFLKKSRERFISLSLEKQCVVIFEVLHLMQCNSVTADLTLLGGVPNAGSLVSSKFVQDNEMKIIYQSCTGYYREIIDFKRFL

SEQ ID NO: 10206 - protein, 133 aa, unidentified
  REGION 1..133: note = Description of Unknown:uncultivated organism sequence
SNYMRDRKRLNKPDLCAGDKITAECNIRLYDALVEKLGSSVYAGLSVKGQVPFLRGKREAFAELSREDQCKIIFEVLHLMQCNSVLSDFSSLGGVAHAGSILSNKFVQDMDIKMIFQSPTGYYRRVVDLKEFI

SEQ ID NO: 10207 - protein, 137 aa, unidentified
  REGION 1..137: note = Description of Unknown:uncultivated organism sequence
SRFCEKNKKAEGRLTADEQHDGLTKEKNLEFYRMLVKRLEEKPYCLLPMPDSTTLLKSKENVFVMLNIEEQCSVIMEIMHFFQCNSVESDLTLLGGKKTGKVRRSKTIDPDEEILLIYQSPTGFYQKTISLTGFYKA

SEQ ID NO: 10208 - protein, 137 aa, unidentified
  REGION 1..137: note = Description of Unknown:uncultivated organism sequence
SRFCEKNKKAEGKLIADEQHDGLTKDKNLEFYRMLVKRLEEKPYCLLPMPDSTTLLKSKENVFVMLNIEEQCSVIMEIMHFFQCNSVESDLTLLGGKKTGMVRRSKTIDSDEEILLISQSPTGFYQKVISLTGFYKA

SEQ ID NO: 10209 - protein, 133 aa, unidentified
  REGION 1..133: note = Description of Unknown:uncultivated organism sequence
SNYMTDRKLLKRQDLPVGEKIKAEDNVRLYDALVEKLESPVYRGLSIRKQAEFLKKSRERFISLSLEKQCVVIFEVLHLMQCNSVNSDLTLLGGVPNAGSLVNSKFVQDNEMKIIYQSCTGYYREIIDFEKFL

SEQ ID NO: 10210 - protein, 137 aa, unidentified
  REGION 1..137: note = Description of Unknown:uncultivated organism sequence
SRFCEKNKKAEGRLTADEQHDGLTKEKNLEFYRMLVSRLCSAPYSALLGQQAPGLREKESVFMGLTIEAQCSVIMEVMHFFQCNSVTSNLQAIGGVPQAGKIYNNKKLSKNEEILLIYQSPTGFYQKTISLTGFYKA

SEQ ID NO: 10211 - protein, 137 aa, unidentified
  REGION 1..137: note = Description of Unknown:uncultivated organism sequence
SRFCEKNKKAEGKLTADEQHDGLTKEKNLEFYRMLADRLCSAPYSALLGQQAPGLREKESVFMGLTIEAQCSVIMEVMHFFQCNSVTSNLQAIGGVPQAGKIYNNKKLSEYEEILLIYQSPTGFYQKTISLTGFYKA

SEQ ID NO: 10212 - protein, 157 aa, unidentified
  REGION 1..157: note = Description of Unknown:uncultivated organism sequence
NYFGILCIKNKNDNGWKPIILRYDFLKNVSERIELIKILSKIDTHITNNYFLQKINNWITKNIEGFKKFNYIKEDEDIQITKETEVIYLLNKLTYIRKEEKSNSDKSVEQIENKNLFIIKTIEYTDIQVEFSTVREKQVNYKPRLNSVLKEYKRWIK

SEQ ID NO: 10213 - protein, 140 aa, unidentified
  REGION 1..140: note = Description of Unknown:uncultivated organism sequence
TIKSLRIYKNNKDKYVLIAINAKVLKSIKNNLVIDKEELNIKLSEKSIIDKKFIEIKKGTIIIDKNNNQIFYSNGGGNIGINQLEFKPINCSMSSFFSKTNSSKKIKRLFLSLSTLVENYFLADIDVLGNIYNKRKIEIN

SEQ ID NO: 10214 - protein, 139 aa, unidentified
  REGION 1..139: note = Description of Unknown:uncultivated organism sequence
DWTEIRIYKNNSGKFVLVTMNINFFKSTKNKEINKLEIDIPKLNDYLKEQKIENNERFIKLQRGSILRNINDNNLFYISGCTFANKRIEIKSLDTTNELKGLRKQNQIGISTIIENYSLLELDELGNIYSEIKLSDIIK

SEQ ID NO: 10215 - protein, 144 aa, unidentified
  REGION 1..144: note = Description of Unknown:uncultivated organism sequence
DVFVKKNKKGKDEFYLVPIYLSDMGKELPSKAIVPLKFEDEWLQIDDNFSFKFSLYMDDLVKVKKGEKEIFGYFKGTGRTTGSITIEAPDRSIITPSIGVKTQDAFKKYSVDPLGNYTEVKHESRIPLTLIKSNAQRYKEQQKG

SEQ ID NO: 10216 - protein, 136 aa, unidentified
  REGION 1..136: note = Description of Unknown:uncultivated organism sequence
DVFSKKNKKGKEEFYLVPIYLSDMGKDLPNKAIVPLKDEKEWLTLDDSFEFKFSLYMDDLVKVIKGNKEIFGYFKGTGRTTGSITIESHDRSIITPSIGVKTQDNIKKYQVDPLGNFTEIKGEKRLSLKSGKNHKE

SEQ ID NO: 10217 - protein, 117 aa, unidentified
  REGION 1..117: note = Description of Unknown:uncultivated organism sequence
DIWRNARGKYVCVPIFVTDTKGKDDDAFKIPDGEFVCSLHKDDYVRLTTADGMYEGYITQMDHGRNFILYRQDNSKNIVVTKAVGKCTNIEKFAVSLLGTPKPIKLPEQRTPVVKRK

SEQ ID NO: 10218 - protein, 117 aa, unidentified
  REGION 1..117: note = Description of Unknown:uncultivated organism sequence
DIWRNAHGKYVCVPIFVTDTKGKDDDVFKVPDGEFVCSLHKDDYVRLTAADGVYEGYITKMDHGTNFILYRQDNNRTQVVKKSVGKCTNIEKFAVSLLGTPKPIKLPEQRTPVVKRK

SEQ ID NO: 10219 - protein, 115 aa, unidentified
  REGION 1..115: note = Description of Unknown:uncultivated organism sequence
DIWRDARGKYMCVPIFVADTKGKDDNNFKVPDSEFICSLHKDDYVRLTTADGVYEGYITQMDHGTNFILYRQDNSQIQVVKKSVGKCTNIEKFAMSLLGTPKPIKLPEQRTPVVK

SEQ ID NO: 10220 - protein, 132 aa, unidentified
  REGION 1..132: note = Description of Unknown:uncultivated organism sequence
DVFSKKNAKGKEQFYLVPIYLADMVKPEMPNKAIVANKPESDWPVMDDTFIFKFSLFKDDVVKVDDGVFGYYVGTHRGTSAITIEAPDRSETWAGLGARNLKYIKKYQVDPLGRYVEVKSETRVPLNAKQRG

SEQ ID NO: 10221 - protein, 150 aa, unidentified
  REGION 1..150: note = Description of Unknown:uncultivated organism sequence
DVFVKKNKKGKDEFYLVPIYLSDMRKELPNKAVVPLKFEDEWVQLDDSYTFKFSLYMDDLVKVKKGDNEAIFGYFKGTNRCTGAITIEAADRSKKYDGVGVKTQDSFRKYSVDPLGDITEIKHETRMPLTHVKPNAQGYKKKQEKRLLKG

SEQ ID NO: 10222 - protein, 154 aa, unidentified
  REGION 1..154: note = Description of Unknown:uncultivated organism sequence
DVFSKKNKRGKEEYYLVPVYLKDMAAKVLPNKAVVAGKPEEEWLEMDESYVFKFSLFPDDLCFVQKGEKIIFGYYKGANRATASITLEGHDRSFMKEGIGVKTQDRIKKFQVDPLGRYVEVKSEKRLPLKPKSAEQRRRDRWKNDFYKKHPDTK

SEQ ID NO: 10223 - protein, 154 aa, unidentified
  REGION 1..154: note = Description of Unknown:uncultivated organism sequence
DVFSKKNKRGKEQYYLVPVYLKDMAAKVLPNKAVVAGKPEEEWLEMDESYVFKFSLFPDDLCFVQKGEKIIFGYYKGANRATASITLEGHDRSFMKEGIGVKTQDRIKKFQVDPLGRYVEVKSEKRLPLKPKSAEQRRRDRWKNDFYKKHPDTK

SEQ ID NO: 10224 - protein, 160 aa, unidentified
  REGION 1..160: note = Description of Unknown:uncultivated organism sequence
DVYLLDKQYKIVPIYAVDLVSRNFHHYVQPYEKIGNEFLEAKEENFLFSLYKDDYIKITTETDVFQGYFNQYNAQSGQIYLGSMDNSKIFKIRDKNEVSGYHLDKEKKIAINTCIKFEKLQIEILGDIYEVKKESERFFQKMKSNAQKYSEKKTAKQIER

SEQ ID NO: 10225 - protein, 155 aa, unidentified
  REGION 1..155: note = Description of Unknown:uncultivated organism sequence
DVFVKKNKKGKDEFYLVPVYLSDMGKELPNKAIVANKDEKEWVKIDESYIFKFSMFMDDLIKVTKGDKVIFGYFSGTHRGNGSITLEDHDRSKINAGIGVKTQDKIQKFAVDPLGKITEIKHETRLPLTNIKSNKQRIADRKVRREKTEQTKEQG

SEQ ID NO: 10226 - protein, 163 aa, unidentified
  REGION 1..163: note = Description of Unknown:uncultivated organism sequence
DVFVKKNKKGKEQFYLVPVYLSDMGKELPNKAIVAGKDEKDWLIIDDSYTFKFSLYADDFVRVLKSENIDKDKIEGYFDGTDRSTGSIVLEAHDRSARYRGIGVKSLYKFQKFSVDPLGNITEIKQETRLPLTNIKSNKQRMAERKARREKLEQEKQQQTETL

SEQ ID NO: 10227 - protein, 153 aa, unidentified
  REGION 1..153: note = Description of Unknown:uncultivated organism sequence
DVFVKKNKKGKEQFYLVPVYLSDMGKELPNKAIVAKKDEKDWVIIDDSYTFKFSMFMDDLIKITKGNKAILGYFCGTHRGNASITLEEHDRAKITEGIGVKGLDKFQKFSVDPLGNITEIKQETRLPLTNIKSNKQRMAERKARREKLEQEKQ

SEQ ID NO: 10228 - protein, 157 aa, unidentified
  REGION 1..157: note = Description of Unknown:uncultivated organism sequence
DVFVKKNKKGKEQFYLVPVYLSDMGKELPNKAIVPNKDEKDWVIIDDSYTFKFSLYADDFVRVLKSENIDKDKIEGYFDGTDRSTGAIALEAHDRSVRYRGIGVKSLYKFQKFSVDPLGNITEIKQETRLPLTNIKSNKQRMAERKARREKLEQEKQ

SEQ ID NO: 10229 - protein, 159 aa, unidentified
  REGION 1..159: note = Description of Unknown:uncultivated organism sequence
DVFVKKNKKGKEQFYLVPVYLSDMGKELPNKAIVQNKDEKDWVIIDDSYTFKFSMFMDDLIKITKGNKAILGYFCGTHRGNASITLEEHDRAKITEGIGVKGLDKFQKFSVDSLGNITEIKQETRLPLTNIKSNKQRMAERKARREKLEQEKQQQTEIL

SEQ ID NO: 10230 - protein, 153 aa, unidentified
  REGION 1..153: note = Description of Unknown:uncultivated organism sequence
DVFVKKNKKGKEQFYLVPVYLSDMGKELPNKAIVPNKDEKDWVIIDDSYTFKFSMFMDDLIKITKGNKAILGYFCGTHRGNASITLEEHDRAKITEGIGVKGLDKFQKFSVDPLGNRIEIKQETRLPLTNIKSNKQRMAERKARREKLEQEKQ

SEQ ID NO: 10231 - protein, 134 aa, unidentified
  REGION 1..134: note = Description of Unknown:uncultivated organism sequence
DIWRDARGKYVCVPIFVADTKGKDDNNFKVPDGEFICSLHKDDYVRIYTSNQVIEGYISQMQEVIHGDKIYRYLALYTHDNHKTIVCKDDKSKAVPEIFRANVSDATNIEKFAMSLLGTPKPIKLPEQRTPVVK

SEQ ID NO: 10232 - protein, 115 aa, unidentified
  REGION 1..115: note = Description of Unknown:uncultivated organism sequence
DIWRDARGKYMCIPIFVADTKGKDDNNFKVPDSEFICSLHKDDYVRLTTADGVYEGYITQMDHGTNFILYRQDNSQIQVVKKSVGKCTNIEKFAMSLLGTPKPIKLPEQRTPVVK

SEQ ID NO: 10233 - protein, 115 aa, unidentified
  REGION 1..115: note = Description of Unknown:uncultivated organism sequence
DIWRDARGKYMCVPIFVADTKGKDDNNFKVPDSEFICSLHKDDYVRLTTADAVYEGYITQMDHGTNFILYRQDNSQIQVVKKSVGKCTNIEKFAMSLLGTPKPIKLPEQRTPVVK

SEQ ID NO: 10234 - protein, 206 aa, unidentified
  REGION 1..206: note = Description of Unknown:uncultivated organism sequence
DVFEKGGRFFIVPVYLADFCEKNRSDCFCPKDKEHEKPDETYKFLFSVFKDDYLSIETNKGEKFYGYMNQYITSTGQFYIGSNDSSPMYSISTSSFEKQDILLYRIGEKFEKCSVVDFDSEKQEMKVASLEDGSIHKIKASAKVNKKGETQKIYKTDKPYEKLDKGKTISSATFKRIRKYQVDPLGRYVEVKSEIRLPLNIKKGKS

SEQ ID NO: 10235 - protein, 212 aa, unidentified
  REGION 1..212: note = Description of Unknown:uncultivated organism sequence
DVFRKENHFYIVPIYVVDLVNCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMMKKNRHKKGE

SEQ ID NO: 10236 - protein, 212 aa, unidentified
  REGION 1..212: note = Description of Unknown:uncultivated organism sequence
DVFRKENHFYIVPIYVVDLVNCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10237 - protein, 154 aa, unidentified
  REGION 1..154: note = Description of Unknown:uncultivated organism sequence
DVFSKKNKRGKEQYYLVPVYLKDMAAKVLPNKAVVVGKPEEEWLEMDESYTFKFSLFPDDLCFVQKGEKKILGYYNGTDRSTAAISLEGHDRSFMKRGIGVKTLDTIRKFQVDPLGRCVEVKSEKRLPLKPKSAEQRRQDRWKNDFYKKHPETK

SEQ ID NO: 10238 - protein, 155 aa, unidentified
  REGION 1..155: note = Description of Unknown:uncultivated organism sequence
DVFVKKNKKGKDEFYLVPVYLSDMGKELPNKAIVANKDEKEWVKIDESYIFKFSMFMDDLIKVTKGDKVIFGYFSGTHRGNGSITLEDHDRSKITAGIGVKTQDKIQKFAVDPLGKITEIKHETRLPLTNIKSNKQRIADRKVRREKTEQTKEQG

SEQ ID NO: 10239 - protein, 212 aa, unidentified
  REGION 1..212: note = Description of Unknown:uncultivated organism sequence
DVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10240 - protein, 212 aa, unidentified
  REGION 1..212: note = Description of Unknown:uncultivated organism sequence
DVFRKENHFYIVPIYVVDLVNCKEFTDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10241 - protein, 140 aa, unidentified
  REGION 1..140: note = Description of Unknown:uncultivated organism sequence
DVFVKKNKKGKDEFYLVPVYLSDMGKELPNKAMVPGKKENEWIELDETYQFKFSFYMDDLIKIKKKENEIFGYFRGTNRATASVSVTTHDRSHTFEGIGVKTQDGIEKYQVDPLGRIAKVKKETRLPLTMMKKNRHKKGE

SEQ ID NO: 10242 - protein, 140 aa, unidentified
  REGION 1..140: note = Description of Unknown:uncultivated organism sequence
DVFVKKNKKGKDEFYLVPVYLSDMGKELPNKAMVPGKKENEWLELDETYQFKFSFYMDDLIKIKKKENEIFGYFRGTNRATASVSVATHDRSHTFEGIGVKTLDGIEKYQVDPLGRIAKVKKETRLPLTMIKKNRHKKGE

SEQ ID NO: 10243 - protein, 140 aa, unidentified
  REGION 1..140: note = Description of Unknown:uncultivated organism sequence
DVFVKKNKKGKDEFYLVPVYLSDMGKELPNKAMVPGKKENEWIELDETCQFKFSFYMDDLIKIKKKENEIFGYFRGTNRATASVSVTTHDRSHTFEGIGVKTQDGIEKYQVDPLGRIAKVKKEIRLPLTMMKKNRHKKEE

SEQ ID NO: 10244 - protein, 150 aa, unidentified
  REGION 1..150: note = Description of Unknown:uncultivated organism sequence
DVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGD

SEQ ID NO: 10245 - protein, 145 aa, unidentified
  REGION 1..145: note = Description of Unknown:uncultivated organism sequence
DVFVKKNKKGKDEFYLVPIYLSDMGKELPSKAIVPLKFEDEWLQLDNSYTFKFSLYMDDLVKVKKGEKKIFGYFKGTGRTTGSITIEEPDRSSITPSIGVKTQDSIQKYAVDPLGNITEIKHETRMPLTHIKSNAQRHQERQAKK

SEQ ID NO: 10246 - protein, 157 aa, unidentified
  REGION 1..157: note = Description of Unknown:uncultivated organism sequence
DVYKTNTGYKIVPIYVVDLVNKEFKHYIQPYEEIDGNKIEAQEADFFCSLYKDDYIEIYVDKDEKYGGYFNQYNAQSGQIYLGSVDNASVYKIRDKKETNGYHLANEKKISLSKCVKLQKYIISPLGDKVLVQKETQRFSNITKSNAQRHKERQQKG

SEQ ID NO: 10247 - protein, 212 aa, unidentified
  REGION 1..212: note = Description of Unknown:uncultivated organism sequence
DVFRKENHFYIVPIYVVDLVDCKEFIDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10248 - protein, 206 aa, unidentified
  REGION 1..206: note = Description of Unknown:uncultivated organism sequence
DIFEKSGKFFVVPVYLADFYEENRADCFSPNDREHEKPDETYQFKFSIFKDDFLSIETDKGEKFYGYMNQYGAQTGQFYIGSNDSSAMYSLSTSSFKERDIIIFPTNKGGIKCTVVGFNDESNKMQLVALNNDAIFEVDATAKINKKGEIQKIYKTGRTYEKLDNEKKISISVFKRIKKYQVDPLGRYVEVKSETRLPLNIKKGNP

SEQ ID NO: 10249 - protein, 136 aa, unidentified
  REGION 1..136: note = Description of Unknown:uncultivated organism sequence
DLFTKENKSGKKEYFFVPIYISDMGKELPNKAISKSKNGWIEMDANYNFCFSIYSNTLLSINMTGNPEDENFWYFRSIDRSDSRLTLDSHDRSIKEKRISPKNAFSIKKYQIDVLGEYHEVKREKRQHLKGAKYGI

SEQ ID NO: 10250 - protein, 216 aa, unidentified
  REGION 1..216: note = Description of Unknown:uncultivated organism sequence
DVFMKDEKYFIVPIYVVDLVNYKNFVDAPQPYGYSDGQLITIDEHFKFMFSLYKDDYVEIRSDDGVIKGYVNQYNAQSGQLYIGSADNSHIFKINTSTFVKGDRILLKKGDQFLVGKIGEYNKDTQQIEVMCGEEKYLIDAVVKLNKKGEETKNIQTGENYIKLANEKKINISVVNCLKKYQVDPLGRIAIVKKETRLPLVLIKKKRKQRKNGRKA

SEQ ID NO: 10251 - protein, 155 aa, unidentified
  REGION 1..155: note = Description of Unknown:uncultivated organism sequence
DVFVKKNKKGKDEFYLVPVYLSDMGKELPNKAIVANKDEKEWLKIDESYIFKFSMFMDDLIKVTKGDKVIFGYFSGTDRSTSSITLEAQDRSALYRSIGVKTQDEIQKFAVDPLGNITEIKHEIRLSLTNVKSNQQRIADRKARREKVEQAKAQE

SEQ ID NO: 10252 - protein, 206 aa, unidentified
  REGION 1..206: note = Description of Unknown:uncultivated organism sequence
DVFEKGGRFFIVPVYLADFCEKNRSDCFCPKDKEHEKPDETYKFLFSVFKDDYLSIETNKGEKFYGYMNQYITSTGQFYIGSNDSSPMYSISTSSFEKQDILLYRIGEKFEKCSVVDFDSEKQEMKVASLEDGSIHKIKASAKVNKKGEVQKIYKTDKPYEKLDKGKTISSATFKRIRKYQVDPLGRYVEVKSEIRLPLNIKKGKA

SEQ ID NO: 10253 - protein, 212 aa, unidentified
  REGION 1..212: note = Description of Unknown:uncultivated organism sequence
DVFRKENHFYIVPIYVVDLVDCKEFTDAPQPYEYVDGSFIKIDESFNFMFSLYKDDYVEITSKDECIKGYVNQYNAQSGQLYISSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10254 - protein, 212 aa, unidentified
  REGION 1..212: note = Description of Unknown:uncultivated organism sequence
DVFRKENHFYIVPIYVVDLVDCKEFIDAPQPYEYVDGSFIKIDESFNFMFSLYKDDYVEITSQDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10255 - protein, 113 aa, unidentified
  REGION 1..113: note = Description of Unknown:uncultivated organism sequence
DVFRKENHFYIVPIYVVDLVDCKEFIDAPQPYEYVNGSFIKIDESFNFMFSLYKDDYVEITSKDECIKGYVNQYNAQSGQLYIGSVDNSPIFRIKTSTFLRDDNILLKIGDQE

SEQ ID NO: 10256 - protein, 132 aa, unidentified
  REGION 1..132: note = Description of Unknown:uncultivated organism sequence
DVFKKENKKGKNEYFFVPVYVSDFGNDLPNKIFPVTKTSGNIDETYEFCFSLYQDCLISVNMSGNKSDEKYWYYRGFDISTGTITVDSNDREIEKQRISVKKAALIKKYQVGILGDIHEIKKEKRQSIKRKK

SEQ ID NO: 10257 - protein, 212 aa, unidentified
  REGION 1..212: note = Description of Unknown:uncultivated organism sequence
DVFRKENHFYIVPIYVVDLVDCKEFTDAPQPYEYVDGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10258 - protein, 140 aa, unidentified
  REGION 1..140: note = Description of Unknown:uncultivated organism sequence
DVFVKKNKKGKDEFYLVPVYLSDMGKELPNKAMVPGKKENEWLELDETYQFKFSFYMDDLIKIKKKENEIFGYFRGTNRATASVSVATHDRSHTFEGSGVKTLDGIEKYQVDPLGRIAKVKKETRLPLTMIKKNRHKKGE

SEQ ID NO: 10259 - protein, 212 aa, unidentified
  REGION 1..212: note = Description of Unknown:uncultivated organism sequence
DVFRKENHFYIVPIYVVDLVNCKEFIDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10260 - protein, 136 aa, unidentified
  REGION 1..136: note = Description of Unknown:uncultivated organism sequence
DLFTKENRSGKKEYFFVPIYISDMGKELPNKAISKSKNGWIEMDANYNFCFSIYSNTLLSINMTGNPEDENFWYFRSIDRSDSRLTLDSHDRSIKEKRISPKNAFSIKKYQIDVLGEYHEVKREKRQHLKGAKYGI

SEQ ID NO: 10261 - protein, 212 aa, unidentified
  REGION 1..212: note = Description of Unknown:uncultivated organism sequence
DVFRKENHFYIVPIYVVDLVDYKEFIDAPQPYEYVDGSFIKIDESFNFMFSLYKDDYVEITSKDECIKGYVNQYNAQSGQLYIGSVDNSPVFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10262 - protein, 212 aa, unidentified
  REGION 1..212: note = Description of Unknown:uncultivated organism sequence
DVFRKENHFYIVPIYVVDLVDCKEFTDAPQPYEYVNGSFIKIDESFNFMFSLYKDDYVEITSKDECIKGYVNQYNAQSGQLYIGSVDNSPIFRIKTSTFLRDDNILLKIGDQEYIGKIGKFDNEKKQVVINGLKNNFMINALVKLNKKGDETKNIQTEKSYTKMSNEKKICLNVVDSIEKYQVDPLGRIAKVKKETRLPLTMIKKNRHKKGE

SEQ ID NO: 10263 - protein, 157 aa, unidentified
  REGION 1..157: note = Description of Unknown:uncultivated organism sequence
DVYRTSTGYKFVPIYVVDLVNKKFKHYFQPYEEIDGCKIEANENDFLFSLYKDDYIEIYLNGDEVYVGYFNQYNAQSGQIYLGAVDNASIYKIRDKKAIDGYHLDNEKKISLSKCVKLQKFVISPLGDKVLVKREKRRFSNTIKSNAQRYKERQQKG

SEQ ID NO: 10264 - protein, 151 aa, unidentified
  REGION 1..151: note = Description of Unknown:uncultivated organism sequence
KPYRTDFYRNEEGIYKFITIRMHHVRYSKSRNTYYIDSELYNSLLEDKGVDNSFEFQFSMHRNEYLLMEQKILVSKNIHDINKEIYRYIATNNDDKNVVEVKPINYREQKRIMKTIGRNIIKLSKYHSDNLGNLYLSKNESLKLEFKIGIM

SEQ ID NO: 10265 - protein, 151 aa, unidentified
  REGION 1..151: note = Description of Unknown:uncultivated organism sequence
KSYRTDFYRNKEGFYKFVTIRMHHVQHSKSRNIYFIDKNVYSKLLEEKGVGNDFEFQFSMHRNEYLYIEQKIRISKNIYDVDKEIYRYVATNNDNKNVVEVKPINYRENKQVMKTIGKNILKLTKYHCDILGNIYESNNESLKLEFNIGKM

SEQ ID NO: 10266 - protein, 138 aa, unidentified
  REGION 1..138: note = Description of Unknown:uncultivated organism sequence
SPYRTDFYLTKEGNYKFLTVKYANIKENHNGYYIPKEVYESLKKSKKINDSDEFLFSLYRNDYLRISTNDPAENAPMIYRFVETTDDLKNVVKVEPIYCEIYIRKTIGKKITKIEKFDVDVLGNKIAKKRDKCLQLEL

SEQ ID NO: 10267 - protein, 143 aa, unidentified
  REGION 1..143: note = Description of Unknown:uncultivated organism sequence
SPYRTDVYQSKETGLYNFITIRRYHIYQENDMNIIKPELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 10268 - protein, 143 aa, unidentified
  REGION 1..143: note = Description of Unknown:uncultivated organism sequence
SPYRTDVYQSKETGLYNFITIRRYHIYQENDMNIIKPELYQKLLSDKRIDETYEFKFSLNRNDIINLVTVDNQAYHINEMLYRFIGTNNDKTNKIEIRYIEKMTLKRIMVSIGKKIVKFEKYNVSPTGKKAKAEKEVLKLKWK

SEQ ID NO: 10269 - protein, 142 aa, unidentified
  REGION 1..142: note = Description of Unknown:uncultivated organism sequence
SPYRTDFYLTKEGNYKFLTIRYANIRENHNGYYIPKEVYESLKKSKKINDSDEFLFSLYQNDYLRITTNDPTENVPMIYRFVGTNNDLANKVEVKPIYCNKIDKPQIMKTIGKKVTKIEKFDVDVLGNKIAKKRDKCLQLEL

SEQ ID NO: 10270 - protein, 142 aa, unidentified
  REGION 1..142: note = Description of Unknown:uncultivated organism sequence
SPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCNKIDKPQIMKTIGKKVTKIEKFDVDVLGNKIAKKRDKCLQLEL

SEQ ID NO: 10271 - protein, 143 aa, unidentified
  REGION 1..143: note = Description of Unknown:uncultivated organism sequence
SPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVCPTGKKAKAEKEVLKLKWK

SEQ ID NO: 10272 - protein, 143 aa, unidentified
  REGION 1..143: note = Description of Unknown:uncultivated organism sequence
SPYRTDVYQSKETGLYNFITIRRYHIYQENDMNIIKPELYQKLLSDKRIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 10273 - protein, 143 aa, unidentified
  REGION 1..143: note = Description of Unknown:uncultivated organism sequence
SPYRTDVYQSKETGLYNFITIRRYHIYQENDMNIIKPELYQKLLSDKRIDETYEFKFSLNRNDIINLVTVDNQAKHIDEMLYRFIGTNNDKTNQIEIRYIEKMTLKQIMVSIGKKIVKFEKYNVSPTGKKAKAEKEVLKLKWK

SEQ ID NO: 10274 - protein, 142 aa, unidentified
  REGION 1..142: note = Description of Unknown:uncultivated organism sequence
TPYRTDFYRRPNGKLSFVTIRLKDIKPIGDPINGQYHIPEDLYKQKLQEAGLQDAKFLYSFHRNEIIEIVKKEKDGTISRSRYRFVATNDDKAKVIEVKEISKKTEKRETPYVNSLHDIVKYAYSPIGKIKKIDSEVLKLRV

SEQ ID NO: 10275 - protein, 144 aa, unidentified
  REGION 1..144: note = Description of Unknown:uncultivated organism sequence
SPYRTDFYKNADGTIKFVTVRRKDLKPINNNKQFVMDETLYEQKKLEKGITKDAAFINSFNRNEIIEITSKDKEGVKKKQYRFIVTNNDTSNSIEVKPISSESLKLRIMLTIGRKTLDITKYAVSPIGEMSKIEKESLKLVVNA

SEQ ID NO: 10276 - protein, 144 aa, unidentified
  REGION 1..144: note = Description of Unknown:uncultivated organism sequence
SPYRTDFYKNADGTIKFVTVRRKDLKPINNNKQFVMDETLYEQKKLEKGITKDAAFINSFNRNEIIEITSKDKEGVKKKQYRFIVTNNDTSNSIEVKPISSESLKPQIMLTIGRKTLDITKYAVSPIGEMSKIEKESLKLIINA

SEQ ID NO: 10277 - protein, 144 aa, unidentified
  REGION 1..144: note = Description of Unknown:uncultivated organism sequence
SPYRTDFYKNADGTIKFVTVRRKDLKPINNNKQFVMDETLYEQKKLEKGITKDAAFINSFNRNEIIEITSKDKEGVKKKQYRFIVTNNDTSNSIEVKPISSESLKPQIMLTIGRKTLDITKYAVSPIGEMSKIEKESLKLVVNA

SEQ ID NO: 10278 - protein, 144 aa, unidentified
  REGION 1..144: note = Description of Unknown:uncultivated organism sequence
SPYRTDFYKNADGTIKFVTVRRKDLKPINNNKQFVMDETLYEKRKKEKGIKPDSTFINSFNRNEIIEITSKDKEGVKKKQYRFIVTNDDAANKIEVKPISSESLKLRIMLTIGRKTLDITKYAVSPIGEMSKIEKESLKLIINA

SEQ ID NO: 10279 - protein, 139 aa, unidentified
  REGION 1..139: note = Description of Unknown:uncultivated organism sequence
PAYRIDVYQEPTGLYKFVTIRYYDLKPKGNSFEIDQSNYNSKLKQKKISSEATFKFSLHKNEVIRCVIITGKTLATYYYKFNGINDDGKNKVEVKTINSKGNKQIIVYVGSKMKQLNKFAVSPAGKFIKIENEILKMRV

SEQ ID NO: 10280 - protein, 140 aa, unidentified
  REGION 1..140: note = Description of Unknown:uncultivated organism sequence
KNFRIDFYKSKNGIYKFLVIKYYYIDKINNKYYIPLNIYEKLKKDRCINDSDEFLFSVYKNEYLRITTKDSKKNVPNIYRFIGTTHNTIELKPLYCDEEQEKKRNRPTIGKKITKIEKFDVDVLGNKIAKKRDKCLQLEL

SEQ ID NO: 10281 - protein, 142 aa, unidentified
  REGION 1..142: note = Description of Unknown:uncultivated organism sequence
SPYRTDFYLTKEGNYKFLTIKYANIKENHNGYYIPKEVYETLKKSKKINDSDEFLFSLYRNDYLRITTNDPTENAPMIYRFVGTKKDLNNVIEVKPIYCDKIDKPQIEKTIGKKVTKIEKFDVDVLGNKIAKKRDKCLQLEL

SEQ ID NO: 10282 - protein, 143 aa, unidentified
  REGION 1..143: note = Description of Unknown:uncultivated organism sequence
SPYRTDVYQSKETGLYNFITIRRYHIYQENDMNIIKPELYQKLLSDKKIDETYEFKFLLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 10283 - protein, 143 aa, unidentified
  REGION 1..143: note = Description of Unknown:uncultivated organism sequence
SPYRTDVYQSKETGLYNFITIRRYHIYQENDMNIIKPELYQKLLSDKRIDETYEFKFSLNRNDIINLVTVDNQADHINEMLYRFIGTNNDKTNKIEIRYIEKMTLKRIMVSIGKKIVKFEKYNVSPTGKKAKAEKEVLKLKWK

SEQ ID NO: 10284 - protein, 143 aa, unidentified
  REGION 1..143: note = Description of Unknown:uncultivated organism sequence
SPYRTDVYQSKETGLYNFITIRRYHIYQENDMNIIKSELYQKLLSDKKIDETYEFKFSLNRNDIINLVTVDNQADHINEMLYRFIGTNNDKTNRIEIRYIEKMTLKQIMVSIGKKIVKFEKYNVSPTGKKAKAEKEVLKLKWK

SEQ ID NO: 10285 - protein, 102 aa, unidentified
  REGION 1..102: note = Description of Unknown:uncultivated organism sequence
SPYRTDVYQSKETGLYNFITIRRYHIYQENDMNIIKPELYQKLLSDKKIDETYEFKFSLNRNDIINLVTIDNQADHIDEMLYNLLELIMIRQIKLRLDILKK

SEQ ID NO: 10286 - protein, 143 aa, unidentified
  REGION 1..143: note = Description of Unknown:uncultivated organism sequence
SPYRTDVYQSKETGLYNFITIRRYHIYQENDMNIIKPELYQKLLSDKKNDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 10287 - protein, 142 aa, unidentified
  REGION 1..142: note = Description of Unknown:uncultivated organism sequence
SPYRTDFYLTKEGNYKFLTIKYANIKENHNGYYIPKDVYESLKKSKKINDSDEFLFSLYRNDYLRITTNDPTENVPMIYRFVGTNNDLKNVVEVKPIYCDKIDKPQIMKTIGKKVTKIEKFDVDVLGNKIAKKRDKCLQLEL

SEQ ID NO: 10288 - protein, 142 aa, unidentified
  REGION 1..142: note = Description of Unknown:uncultivated organism sequence
SPYRTDFYLTKEGNYKFLTIKYANIKENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 10289 - protein, 143 aa, unidentified
  REGION 1..143: note = Description of Unknown:uncultivated organism sequence
SPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKAEKEVLKLKWK

SEQ ID NO: 10290 - protein, 143 aa, unidentified
  REGION 1..143: note = Description of Unknown:uncultivated organism sequence
SPYRTDVYQSKETGLYNFITIRRYHIYQENDMNIIKPELYQKLLSDKKIDETYEFKFSLNRNDIINLVTIDNQADHIDEMLYRFIGTNNDKTNKIEIRYIEKMTLKQIMVSIGKKIVKFEKYNVSPTGKKAKTEKEVLKLKWK

SEQ ID NO: 10291 - protein, 142 aa, unidentified
  REGION 1..142: note = Description of Unknown:uncultivated organism sequence
SPYRTDFYLTKEGNYKFLTIKYANIKENHNGYYIPKDVYESLKKSKKINDSDEFLFSLYRNDYLRITTNDPTENAPMIYRFVGTNNDLENKVEVKPIYCDKNEENRIMKTIGKKVTKIEKFDVDVLGNKIAKKRDKCLQLEL

SEQ ID NO: 10292 - protein, 142 aa, unidentified
  REGION 1..142: note = Description of Unknown:uncultivated organism sequence
SPYRTDFYLTKEGNYKFLTIRYANIRENHNGYYIPKEVYESLKKSKKINDSDEFLFSLYRNDYLRITTNDPAENVPMIYRFVGTNNDLKNVVEVKPIYCDKNEENRIMKTIGKKVTKIEKFDVDVLGNKIAKKRDKCLQLEL

SEQ ID NO: 10293 - protein, 136 aa, unidentified
  REGION 1..136: note = Description of Unknown:uncultivated organism sequence
RPYRTDIYKDSNDNYKFVTIRYADFSSDAKGYYIDKNLYAEKLQQKGISENFKFTNSFHTNEIIAFKRKDEEFGYYRFVGTNNDVTNQIEIKSINKKDNKRNKPAIGKKIEKIYKYAVSPAGRIKRVENERLTLVR

SEQ ID NO: 10294 - protein, 144 aa, unidentified
  REGION 1..144: note = Description of Unknown:uncultivated organism sequence
NPYRADIYKLENGSYKMAIIRYSDLRQLDNERYIIDEEIYNNILSSVGIDKGDQFQFSIYKNTIIKYYTNDEELTYRAIGFSGNRIEVKGLYENYGRYNSEGNFVMDRVRITIGAKNPKKLEKYNVSIIGQTSKVESEPLQLII

SEQ ID NO: 10295 - protein, 141 aa, unidentified
  REGION 1..141: note = Description of Unknown:uncultivated organism sequence
TTYRIDIYKSRVSGLYNFVTIRNHNIKSNNEGFYIDECFYNSEKARKGITDEFEFQFSLHKNEVVELTKDEPALLRFVGVNSERINRLEFKPLHCDRLVINEKEKRIRIDINKNVLNICKYNVDVLGNLYQVSQEELKLKF

SEQ ID NO: 10296 - protein, 141 aa, unidentified
  REGION 1..141: note = Description of Unknown:uncultivated organism sequence
SPYRTDIYITKDGLYKMLTIKRYHISQCGNKNIIKKEVYDELMKLKKINEEDEFLFSLNRYNIINVLNKSDVENGEKQKLYRFIATNNDNKNIIEVKLIEKKDETRQMKTIGKSIILIEKYNVSATGKMSKVVKEELKLEW

SEQ ID NO: 10297 - protein, 144 aa, unidentified
  REGION 1..144: note = Description of Unknown:uncultivated organism sequence
SPYRTDFYKNADGTIKFVTVRRKDLKPINNNKQFVMDETLYEQKKLEKGITKDAAFINSFNRNEIIEITSKDKEGVKKKQYRFIATSNDTSNSIEVKPISSESLKPRIMLTIGRKTLDITKYAVSPIGEMSKIEKESLKLVVNA

SEQ ID NO: 10298 - protein, 144 aa, unidentified
  REGION 1..144: note = Description of Unknown:uncultivated organism sequence
SPYRTDFYKNADGTIKFVTVRRKDLKPINNNKQFVMDETLYEQKKLEKGITKDAAFINSFNRNEIIEITSKDKEGVKKKQYRFIATNNDTLNSIEVKPISSESLKPQIMLTIGRKTLDITKYAVSPIGEMSKIEKESLKLVVNA

SEQ ID NO: 10299 - protein, 144 aa, unidentified
  REGION 1..144: note = Description of Unknown:uncultivated organism sequence
SPYRTDFYKNADGTIKFVTVRRKDLKPINNNKQFVMDETLYEQKKLEKGITKDATFINSFNRNEIIEITSKDKEGVNKKQYRFIATNTDTLNRIEVKPISSESLKPRIMLTIGRKTLDITKYAVSPIGEMSKIEKESLKLVVNA

SEQ ID NO: 10300 - protein, 151 aa, unidentified
  REGION 1..151: note = Description of Unknown:uncultivated organism sequence
KPYRTDFYVNEKGQYKFVTIRMNDVRYSGEKKLFVIEKEWYENEKTRKGVDKTFNFVFSMHRDELMYLEKIERNRDKSETVFKDVWRFVATNDDDKNVIQYNFTHYNASKQERITIGGKIKKIAKVHTDILGKLYESKDNKLKLEFTIDKI

SEQ ID NO: 10301 - protein, 141 aa, unidentified
  REGION 1..141: note = Description of Unknown:uncultivated organism sequence
KTYRIDIYKSRVSGLYNFVTIRNHNIKSNKEGFYIDECFYNSEKARKGITDEFEFLFSLHKNEVVELTKDEPALLRFVGVNTEITNRLEFKPLHCDRLVINEKKKRIRIDINKNVLNICKYNVDVLGNLYQVSKEELKLKF

SEQ ID NO: 10302 - protein, 141 aa, unidentified
  REGION 1..141: note = Description of Unknown:uncultivated organism sequence
KTYRIDIYKSRVSGLYNFVTIRNHNIKSNKEGFYIDECFYNSEKARKGITDEFEFLFSLHKNEVVELTKDEPALLRFVGVNTEITNRLEFKPLHCDRLVINEKKKRIRIDINKNVLNICKYNVDVLGNLYQVSQEELKLKF

SEQ ID NO: 10303 - protein, 139 aa, unidentified
  REGION 1..139: note = Description of Unknown:uncultivated organism sequence
SPYRTDFYVSPSGLYRFVTIRYANVKMSNKEGTIDLVEYEQMKQLKKIDDTYQFCFSLHRNETIKITKKGENPHTYRFVGTNSDKLNRIEVKELYCNVLKEERRIILTIGKEICLLEKFSCDILGNMKKIESEVLKLKI

SEQ ID NO: 10304 - protein, 143 aa, unidentified
  REGION 1..143: note = Description of Unknown:uncultivated organism sequence
SPYRTDVYQSKETGRYNFITIRRYHIYQENDMNIIKPELYQKLLSDKKIDATYEFKFSLNRNDIINLVTIDNQADHIDEMLYRFIGTNNDKTNKIEIRYIEKMTLKQNIVSISKKIVKFEKYNVSPTGKKAKTEKEVLKLKWK

SEQ ID NO: 10305 - protein, 122 aa, unidentified
  REGION 1..122: note = Description of Unknown:uncultivated organism sequence
DVYQKQNAKGKVEHFFVPVYAHQIGRNRPVPTNILPAPKGFTDVDETFTKITSLFPNDYVRFYFGNEIKEGYYVKYGSAAGQIYIIQQSAANKDNLIAISARSAVSIERFDISILGDNAPRI

SEQ ID NO: 10306 - protein, 138 aa, unidentified
  REGION 1..138: note = Description of Unknown:uncultivated organism sequence
DVFIRKNYKGIDEYYFAPVYTHLVRAKKIEVLPTPNGRSAEEKADFNKIRETDGKIYATTENGFEKQFSIYPNDYVRIYMNNKVVEGYYVKYNINGGRVQVISHSETNKENLVALSPKTASDIKRYDISILGDNYKWL

SEQ ID NO: 10307 - protein, 124 aa, unidentified
  REGION 1..124: note = Description of Unknown:uncultivated organism sequence
DVYQKPNKKGKIEHFFVPVYAHQIGKNKLTPTKILPAPKDFTNVDETFTKVCSLYPNDYVRIYLKNEIREGYYVKYNVANGAMQLLPNYAPGKNQGTFVQVYGKNAQAIERYDISILGDNYRWL

SEQ ID NO: 10308 - protein, 124 aa, unidentified
  REGION 1..124: note = Description of Unknown:uncultivated organism sequence
DVYQKPNKKGKIEHFFVPVYAHQVGKNKPTPTKILPAPKGFTDIDETFTKVCSLYPNDYVRIYLKNKILEGYYSGYDISVGTVILYPHFTPSKDIKVANRVSARSATLIERYDIAILGDNYRWL

SEQ ID NO: 10309 - protein, 140 aa, unidentified
  REGION 1..140: note = Description of Unknown:uncultivated organism sequence
DVYKRKNYKDIYEYYFTPVYTHLINTQRIEVLPTPTGRSKNEKADFDTIRTEGNKIYATLENGFIKQFSIYPNDYVRIYFDNEIVEGYYVKYNTNDSSLKLIKHSDTSKNDSDLISKVAKTATLIERYDIAVLGDNYRWL

SEQ ID NO: 10310 - protein, 140 aa, unidentified
  REGION 1..140: note = Description of Unknown:uncultivated organism sequence
DVYKRKNYKGIYEYYFAPVYTHLINTQKIEVLPTPTGRSKNEKADFDTIRTEDDKIYATLENGFIKQFSIYPNDYVRIYFDNEIIEGYYVKYNTNDGSLKLIKHSDASKNDNDLISKVAKTATLIERYDISILGDNYRWL

SEQ ID NO: 10311 - protein, 124 aa, unidentified
  REGION 1..124: note = Description of Unknown:uncultivated organism sequence
DVYQKQNQKGKIEHFFVPVYAHQVGKNQPAPTKILPAPKGFTDVDKTFTKVCSLYPNDYVRCYFKNTIEEGYYLAYDSASGQITVLGHSAANKEGDNRVRISPRSATLIRRYDISILGDNAPRP

SEQ ID NO: 10312 - protein, 111 aa, unidentified
  REGION 1..111: note = Description of Unknown:uncultivated organism sequence
SILCQHTTTNHYKVVPVYFRQIHANKKTELGEGWKYISRIVPNDFVVIIKKDGSKISGYYKTRKGDTLISILPHQHSDSSKAVSQRIGTAKEIHIYNISALGDNAPEEEYK

SEQ ID NO: 10313 - protein, 125 aa, unidentified
  REGION 1..125: note = Description of Unknown:uncultivated organism sequence
DVYQKPNKKGKIEHFFVPVYAHQVGKNKPTPTKILPAPKGFTDVDETFTKVCSLYPNDYVMCKFSENRVEEGYYVMYGIAVGQMVLLPHEVSGKDQKTMRSISPRSAASIERYDISVLGDNYRWL

SEQ ID NO: 10314 - protein, 138 aa, unidentified
  REGION 1..138: note = Description of Unknown:uncultivated organism sequence
DVFKRKNYKGEFEYYFSPIYAHLLNAKKVEILPTPNGRSAAEKADFNKIRDENGKIFATEENGFVKQFSLYPNDYVRIYAKNKIVEGYYVKYNIANGSISLIGHDKADKKNIDGVSGGTITSIERYDISVLGDNYRWI

SEQ ID NO: 10315 - protein, 111 aa, unidentified
  REGION 1..111: note = Description of Unknown:uncultivated organism sequence
SILCQSSTTGHYKVVPVYFRQIHANENIELEEGWKYISRIVPNDFVVIIKKDGSKISGYYKTRKGDTLISILPHQHSDSSRAISQRIGTTKEIRIYNISVLGDNAPEEEYK

SEQ ID NO: 10316 - protein, 124 aa, unidentified
  REGION 1..124: note = Description of Unknown:uncultivated organism sequence
DVYQKPNKRGKIEHFFVPVYAHQVGKNKPAPTKILPAPKGFTNIDETFTKVCSLYPNDYVRIYLKNEIREGYYVKYNVANGAMQLLPNYAPGKNQGTFIQVYGKNAQTIERYDISVLGDNCEWL

SEQ ID NO: 10317 - protein, 111 aa, unidentified
  REGION 1..111: note = Description of Unknown:uncultivated organism sequence
SILCQNSTTGHYKVAPVYFRQIHANKKTELGEGWKYISRIVPNDFVVIIKKDGSKISGYYKTRKGDTLISILPHQHSDSSKAVYQRIGTAKEIHIYNISALGDNAPEEEYK

SEQ ID NO: 10318 - protein, 140 aa, unidentified
  REGION 1..140: note = Description of Unknown:uncultivated organism sequence
DVYKRKNYKDIYEYYFAPVYTHLINAQKIEVLPTPTGRSKNEKVDFDTIRTEDDKIYATLENGFIKQFSIYPNDYVRIYFDNEIVEGYYVKYNTNDGSLKLIKHSETSKNDNDLISKAAKTANLIERYDISILGDNYRWL

SEQ ID NO: 10319 - protein, 121 aa, unidentified
  REGION 1..121: note = Description of Unknown:uncultivated organism sequence
DIYQKEVKGKNQLFYVPIYTHQVKKGSTRILPTTCGYDYVDETFKKLFSLYPNDYIVMKKDENISQGYYIGYDTAVSSISYISNLISGNSNFNRITGRSLSSIYRLDISILGDNYPWEKLY

SEQ ID NO: 10320 - protein, 134 aa, unidentified
  REGION 1..134: note = Description of Unknown:uncultivated organism sequence
NIYQRQDKFFAAPVYVHTLNRAAEILPTPNGKSKLEKADFNQLRTKDGKIFATKENGFELVMSVFPNDYIRLVYENKTVEGYYVKYGISAGTLSLISHNSTSKNDLDMIHCSVGQAVAIYKLNISVLGDNYIER

SEQ ID NO: 10321 - protein, 140 aa, unidentified
  REGION 1..140: note = Description of Unknown:uncultivated organism sequence
DVYKRKNYKGIYEYYFTPVYTHLINTQKIEVLPTPTGRSKKEKADFDTIRTDDGEIYATLKNGFIKQFSIYPNDYVRIYFGNEIVEGYYVKYNTNDGSLKLIKHSETSKNDNDLISKSAKTATLIKRYDISVLGDNYRWL

SEQ ID NO: 10322 - protein, 164 aa, unidentified
  REGION 1..164: note = Description of Unknown:uncultivated organism sequence
DVYKHPNKKGKIEHFFVPVYAHMIKKGHPEIKPTKILPEPKKGTPTEVDDSFSFVCSLFPNDYVKVTLGSEVKEGYYVSYDIQSARITLLPHAGTSKDLPTKKKDKSSNDDQTDQSTDEADDNDKKRAKIKHPNRYPAFRIAPRSATKIERLDINVLGDNYKWG

SEQ ID NO: 10323 - protein, 164 aa, unidentified
  REGION 1..164: note = Description of Unknown:uncultivated organism sequence
DVYKHPNKKGKIEHFFVPVYAHMIKKGHPEIKPTKILPEPKKGTPTEVDDSFSFVCSLFPNDYVKVTLGSEVKEGYYAAYDIAGCKIKLLPHAGTSKDLPTKKKDKSSNGDQTDQSTDEAGDNDKKKTKIKHPNRYPAFRIAPRSATKIERLDINVLGDNYKWD

SEQ ID NO: 10324 - protein, 124 aa, unidentified
  REGION 1..124: note = Description of Unknown:uncultivated organism sequence
DVYQKPNKKGKIEHFFVPVYAHQVGKNKPTPTKILPAPKGFTDIDETFTKICSLYPNDYVRCHFGNEIREGYYASFNINNGAMQVMPHDAANKSNDSLIQISPRSANLIERYDIAILGDNYRWL

SEQ ID NO: 10325 - protein, 124 aa, unidentified
  REGION 1..124: note = Description of Unknown:uncultivated organism sequence
DVYQKQNQKGKIEHFFVPVYAHQVGKNQPTPTKILPAPKGFTDIDDTFMKVCSLYSNDYVRCRFKNKIVEGYYVKYGSASGQMILLPHAAARKDDDTFVTCSARSATLIERYDISILGDNAPRS

SEQ ID NO: 10326 - protein, 138 aa, unidentified
  REGION 1..138: note = Description of Unknown:uncultivated organism sequence
DVFKRKNYKGEFEYYFSPIYAHLLNTKKVEILPTPNGRSAAEKADFNKIRDENGKIFAAEENGFVKQFSLYPNDYVRIYAGNKIVEGYYVGYDIDSGRVSLIGHDKADKKNTDRISGGTITFIERYDISILGDNYRWI

SEQ ID NO: 10327 - protein, 140 aa, unidentified
  REGION 1..140: note = Description of Unknown:uncultivated organism sequence
DVFKRKNYKGEFEYYFSPIYVHLLNAKKVEILPTPNGRSAAEKADFNKIRDENGKIFATEENGFVKQFSLYPNDYVRIYAGNRIVEGYYVKYGITDGTLNLMNHDQTSKDNLSLKHIGRGTITFIERYDISVLGDNYRWI

SEQ ID NO: 10328 - protein, 163 aa, unidentified
  REGION 1..163: note = Description of Unknown:uncultivated organism sequence
DVYKRPNKRGKIEHFFVPVYAHMIKKGHPEIKPTKILPEPKKGTPKEIDSSFSFVCSLFPNDYVKVTLGSEVKEGYYVAYDITNCKIKLLPHAGTSKDLPTKGKDKSNSDQSDQSADETNDNDKKKTGVKHPNRYPAFRIAPRSATKIERLDINVLGDNYKWD

SEQ ID NO: 10329 - protein, 140 aa, unidentified
  REGION 1..140: note = Description of Unknown:uncultivated organism sequence
DVYKRKNYKDIYEYYFAPVYTHLINTQRIEVLPTPTGRSKNEKADFDTIRTEDNKIYATLENGFIKQFSIYPNDYVRIYFDNEIVEGYYVKYNTNDSSLKLIKHSDTSKNDSDLISKVAKTATLIERYDIAVLGDNYRWL

SEQ ID NO: 10330 - protein, 140 aa, unidentified
  REGION 1..140: note = Description of Unknown:uncultivated organism sequence
DVYKRKNYKDIYEYYFAPVYTHLINAQKIEVLPTPTGRSKNEKADFDTIRTEDDKIYATLENGFIKQFSIYPNDYVRIYFGNEIVEGYYVKYNTNDGSLKLIKHSETSKNDNNLISKSAKTATLIERYDISALGDNYRWL

SEQ ID NO: 10331 - protein, 140 aa, unidentified
  REGION 1..140: note = Description of Unknown:uncultivated organism sequence
DVYKRKNYKGIYEYYFTPVYTHLINTQKIEVLPTPTGRSKKEKADFDTIRTDDGEIYATLKNGFIKQFSIYPNDYVRIYFGNEIVEGYYVKYNTNDGSLKLIKHSETSKNDNDLISKSAKTATLIERYDISVLGDNYRWL

SEQ ID NO: 10332 - protein, 128 aa, unidentified
  REGION 1..128: note = Description of Unknown:uncultivated organism sequence
RVYKKDNQIYMIPDYRINILENKETMELLKPLKKVSKIDNSFNFIGYLYKGDLITIQKDSQTFVGYFVQFEGDNRITIKNHLAVDSSRDSKSTVKRESLSGINYLKIHKVDVLGDVNFSEGIVWPGAS

SEQ ID NO: 10333 - protein, 128 aa, unidentified
  REGION 1..128: note = Description of Unknown:uncultivated organism sequence
RVYKKDNQIYMIPDYRINILENKETMELLKPLKKVSKIDNSFNFIGYLYKGDLITIQKDSQTFVGYFVQFEGDNRITIKSHLAADSSRSSKSTVKRESLSGINYLKIHKVDVLGDVNFSEGIVWPGAS

SEQ ID NO: 10334 - protein, 111 aa, unidentified
  REGION 1..111: note = Description of Unknown:uncultivated organism sequence
SILCQNSTTGHYKVAPVYFRQIHANKKTELGEGWKYISRIVPNDFVVIIKKDGSKISGYYKTRKGDTLISILPHQHSDSSKAVSQRIGTAKEIHIYNISALGDNAPEEEYK

SEQ ID NO: 10335 - protein, 122 aa, unidentified
  REGION 1..122: note = Description of Unknown:uncultivated organism sequence
DVYRRSNKKGKIEHFFVPVYAHQVGKNKPAPTKILPAPKGFTDIDETFTKVCSLYPNDYVRCYFNNRVEEGYYVMYGIAVGQMVLLKHSAPGKSETKSISPRSATKIERLDINVLGDNYKWD

SEQ ID NO: 10336 - protein, 121 aa, unidentified
  REGION 1..121: note = Description of Unknown:uncultivated organism sequence
DVYQKDIKGEKKLFYVPIYTHQVRKGSNRILPTTCGYDFIDNTFAKLCSVYPNDYLIMKKGDEILQGYYIKYNVNNSAIAYTSNVKEGRSDFVTATGRALSELYRLDISVLGDNYHWERMY

SEQ ID NO: 10337 - protein, 121 aa, unidentified
  REGION 1..121: note = Description of Unknown:uncultivated organism sequence
DIYQKKVKGKNQLFYVPIYAHQVKKGSTRILPTTCGYDYVDETFKKLFSLYPNDYIIMKKDNNTIQGYYIKYNTSNSVITHISNLMPGSTNFKETTGRSLTEIYRLDISILGDNYPWEKLY

SEQ ID NO: 10338 - protein, 13 aa, unidentified
  REGION 1..13: note = Description of Unknown:uncultivated organism sequence
KISSSQLQFTCTP

SEQ ID NO: 10339 - protein, 140 aa, unidentified
  REGION 1..140: note = Description of Unknown:uncultivated organism sequence
DVFKRKNYKGEFEYYFSPIYVHLLNAKKVEILPTPNGRSAAEKADFNKIRDEDGKIFATEENGFVKQFSLYPNDYVRIYAGNRIVEGYYVKYGITNGTLNLMNHDQTSKDNLSLKHIGCGTITFIERYDISVLGDNYRWI

SEQ ID NO: 10340 - protein, 138 aa, unidentified
  REGION 1..138: note = Description of Unknown:uncultivated organism sequence
DVFKRKNYKGEFEYYFSPIYAHLLNAKKVEILPTPNGRSAAEKADFNKIRDENGKIFATEENGFVKQFSLYPNDYARIYAENKIVEGYYVGYDIDSSRISLIGHDKADKKSTDRISGGMITLIERYDISVLGDNYRWI

SEQ ID NO: 10341 - protein, 138 aa, unidentified
  REGION 1..138: note = Description of Unknown:uncultivated organism sequence
DVFKRKNYKGEFEYYFSPIYVHLLNAKKVEILPTPNGRSSAEKADFNKIRDENGKIFATEENGFVKQFSLYPNDYVRIYTKNKIVEGYYVKYNIANGSIYLIGHDKADKKNIDRVSGGTIASIERYDISVLGDNYRWI

SEQ ID NO: 10342 - protein, 138 aa, unidentified
  REGION 1..138: note = Description of Unknown:uncultivated organism sequence
DVFKRKNYKGEFEYYFSPIYAHLLNAKKVEILPTPNGRSAAEKADFNKIRDENGKIFATEENGFVKQFSLYPNDYARIYAENKIVESYYVGYDIDSSRISLIGHDKADKKSTNRISGGMITLIERYDISVLGDNYRWI

SEQ ID NO: 10343 - protein, 124 aa, unidentified
  REGION 1..124: note = Description of Unknown:uncultivated organism sequence
DVYQKQNQKGRIEHFFVPVYAHQVGKNQSTPTKILPAPKGFADVDETFTKVCSLYPNDYVRCYFKNTIEEGYYLAYDSASGRITVLNHSAANKEGDNRVRISPRSATLIKRYDISILGDNAPRS

SEQ ID NO: 10344 - protein, 128 aa, unidentified
  REGION 1..128: note = Description of Unknown:uncultivated organism sequence
RVYKKDNQIYMIPDYRINILENKETMELLKPLKKVLKIDNSFNFIGYLYKGDLITIQKDSQTFVGYFVQFEGDNRITIKNHLAVDSSRDSKSTVKRESLSGINYLKIHKVDVLGDVNFSEGIVWPGAS

SEQ ID NO: 10345 - protein, 111 aa, unidentified
  REGION 1..111: note = Description of Unknown:uncultivated organism sequence
SILCQSSTTGHYKVVPVYFRQIHANENIELEEGWKYISRIVPNDFVVIIKKDGSKISGYYKTRKGDTLISILPHKHSDSSRAISQRIGTAKEIRIYNISVLGDNTPEEEYK

SEQ ID NO: 10346 - protein, 124 aa, unidentified
  REGION 1..124: note = Description of Unknown:uncultivated organism sequence
DVYQKPNKKGKIEHFFAPVYAHQVGKNKPTPTKILPVPKGFTDVDETFTKVCSLYPNDYVRCYFGNEIKEGYYVKYGINNGAMQVISHNSTGKDKDQLIQISPRSANLIERYDISILGDNYRWL

SEQ ID NO: 10347 - protein, 124 aa, unidentified
  REGION 1..124: note = Description of Unknown:uncultivated organism sequence
DVYQKPNKKGKIEHFFVPVYAHQVGKNKPTPTKILPAPKGFTDVDETFTKVCSLYPNDYVRCHFGNKIREGYYVSFNINNGAMQVMPHDAANKSNDSLIQISPRSANLIERYDIAILGDNYRWL

SEQ ID NO: 10348 - protein, 124 aa, unidentified
  REGION 1..124: note = Description of Unknown:uncultivated organism sequence
DVYQKPNKRGEIEHFFVPVYAHQVGKNKPAPTKILPAPKGFTNIDETFTKVCSLYPNDYVRIYLKNEIREGYYVKYNVANGAMQLLPNYAPGKNQGTFIQVYGKNAQTIERYDISVLGDNCEWL

SEQ ID NO: 10349 - protein, 124 aa, unidentified
  REGION 1..124: note = Description of Unknown:uncultivated organism sequence
DVYQKPNKRGKIEHFFVPVYAHQVGKNKPAPTKILPAPKGFTDVDETFTKVCSLYPNDYVRCYFGNEIKEGYYVKYGINNGAMQVIAHSTASKDKDHLIQISPRSANLIERYDIAILGDNYRWL

SEQ ID NO: 10350 - protein, 124 aa, unidentified
  REGION 1..124: note = Description of Unknown:uncultivated organism sequence
DVYQKPNKKGKIEHFFVPVYAHQVGKNKPTPTKILPAPKGFTDIDETFVKVCSLYPNDYIRIYLKNEIREGYYVKYNVANGAMQLLPNYAPGKNQNTFVQVYGKNAQAIERYDISILGDNYRWL

SEQ ID NO: 10351 - protein, 124 aa, unidentified
  REGION 1..124: note = Description of Unknown:uncultivated organism sequence
DVYQKPNKKGKIEHFFVPVYAHQVGKNRPTPTKILPTPKGFTDVDETFTKVCSLYPNDYVRCYFGNKIKEGYYVKYGINNGAIQVIAHGTTSKDKDHLIQISPRSANLIERYDISVLGDNYRWL

SEQ ID NO: 10352 - protein, 124 aa, unidentified
  REGION 1..124: note = Description of Unknown:uncultivated organism sequence
DVYQKPNKKGKIEHFFVPVYVHQVGKNKPTPTKILPAPKGFTDVDETFTKVCSLYPNDYVRCYFGNEIKEGYYVKYGINNGAMQVIAHSTASKDKDHLIQISPRSANLIERYDIAILGDNYRWL

SEQ ID NO: 10353 - protein, 124 aa, unidentified
  REGION 1..124: note = Description of Unknown:uncultivated organism sequence
DVFQKQNAKGKLEHFFVPVYTHQIPLEKRGEKITKILPAPKGFTDVDESFTKVTSLFPNDYVRVYFGNKVVEGYYVKYGTASGQMALISHLAPGKDDIITCSARSAVSIERHDISILGDNAPRI

SEQ ID NO: 10354 - protein, 147 aa, unidentified
  REGION 1..147: note = Description of Unknown:uncultivated organism sequence
EVYRRKKDTGDGYDYFGAPVYVHALHKKGPREILPTPVGRGKAQQAVYNAMRTPDGHIFADEKFGFEKVTDVYPNDYIRIYLNDGRIAEGYYISYDISNTRISFINHSAADKTQGNLLRIYLSSATNFELLNISLLGDNYKPAKKKE

SEQ ID NO: 10355 - protein, 124 aa, unidentified
  REGION 1..124: note = Description of Unknown:uncultivated organism sequence
DVYQKQSTKGKIEHFFVPVYTYQIGFEKSGQKITKIMPEPKGFTDVNDTFTKVTSLFPNDYVRIYINNKIEEGYYRAYDVAAGQITLLSHSASDAKSTIRVSARSASSIERFDISILGDNYKWI

SEQ ID NO: 10356 - protein, 139 aa, unidentified
  REGION 1..139: note = Description of Unknown:uncultivated organism sequence
STLGMLKYYCIEVYKDAKGKTRIYGIRFVDVVKKNKKLYQKAESYPEDYASHVMYLFTGDFVRITDKKGKLKFEGFYQAVKNINSSILYFSPVNLANTVIKGISLTDNIEKYYVDILGRIGGKIRCSEPLQSTAEKKSL

SEQ ID NO: 10357 - protein, 139 aa, unidentified
  REGION 1..139: note = Description of Unknown:uncultivated organism sequence
TYLGMLKYYCVEVYKDSKGNTKTCGVRFVDIVNRNGKLYRKEESLPGDYSKHVMYLFANDYVTIFDGKGETKFSGYYISVENINSSKFSFKLKNYSSNVIKSISREDTIKKFSISLLGKIGGEIKCSEPLPCIKEREYR

SEQ ID NO: 10358 - protein, 136 aa, unidentified
  REGION 1..136: note = Description of Unknown:uncultivated organism sequence
NILTASKYYCVELYETADGKNNLRGIRYADLKKQGKKLYLTAENPADYKRHKMYLFANDYIEVINQKGECKFKGFYKSVFNINENRVYCNEGNTSKSINKTIAAKDIVKKYNIDILGEMGGEVKCSVPFMLLREKK

SEQ ID NO: 10359 - protein, 136 aa, unidentified
  REGION 1..136: note = Description of Unknown:uncultivated organism sequence
NILTASKYYCIELYETTDGKNNLRGIRYADLRKQNKKLYLTAENPADYKQHKLYLFANDYIEVTNKKGECKFKGFYNSVFNINENRIYCSERNSSKNINKTIAAQDVIKKYNIDILGQIGGEVKCSAPFMLLREKK

SEQ ID NO: 10360 - protein, 135 aa, unidentified
  REGION 1..135: note = Description of Unknown:uncultivated organism sequence
NILNANKYYCIEVYKTIDNTINLRGIRFIDLIRKKGKLKLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 10361 - protein, 145 aa, unidentified
  REGION 1..145: note = Description of Unknown:uncultivated organism sequence
SILGMPKYYCVEVYTNDKGQTKIWGLRFVDMIYYEGKLYLKDGVRPADYARHVMYIFKGEYIKVVTKGKVVCEGTYQNVEAINEKKLNIKIKNTNILQKPIPRIGNKTKVSKYAISLNGCKSGMVKEGETGYPCFAHCLLKKEND

SEQ ID NO: 10362 - protein, 135 aa, unidentified
  REGION 1..135: note = Description of Unknown:uncultivated organism sequence
NILNANKYYCIEVYKTIDNTINLRGIRFIDLIRKKGKLQLVIDNPIDYKHHIMYLFKNDYVKVYKNNKLLFKGYYKSVGNINQNILMFKIDNSSINTLKFIGKQYNIKKYDVNILGKLGGEIKCSVPFMFHKGNN

SEQ ID NO: 10363 - protein, 136 aa, unidentified
  REGION 1..136: note = Description of Unknown:uncultivated organism sequence
NILTASKYYCVELYETADGKNNLRGIRYADLKKQGKKLYLTAENPADYKRHKMYLFANDYIEVINQKGECKFKGFYKSVYAVNENRVYCNEGNTSKSINKTIAAKDIVKKYNIDILGEMGGEVKCSVPFMLLREKK

SEQ ID NO: 10364 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYEGTYQNVYSINQGKLRIKVKNTNALEPISIGNKAGVLKYAISLNGCKSGVVKEGEAGYPCFAHCLSKKEND

SEQ ID NO: 10365 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYEGTYQNVFNINQGKLRVKVKNTNALKTISIGNKAGVFKYAISLNGCKSGVVKEGEAGYPCFAHCLSKKEND

SEQ ID NO: 10366 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHVMYLFPGEYIEVEKKGKIVYEGTYQNVYNINQGVLRIKVKNTNALKPISIGDKAGVFKYAISLNGCKSGVVKEGEAGYPCFAHCLLKKEND

SEQ ID NO: 10367 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 10368 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYEGTYQNVFNINQGKLRIKVKNTNALKTISIGNKAGVFKYAISLNGRKSGVVKEGEAGYPCFAHCLSKKEND

SEQ ID NO: 10369 - protein, 156 aa, unidentified
  REGION 1..156: note = Description of Unknown:uncultivated organism sequence
SILGVPKYYCVEVYKDTKGKTRMWGIRYVDVISCEGKICLKDDIKLPKKYAKHLIYLFSGEYLEVTEDGKETYVGFYQSMKKATQSRINITINPGKKVKGNDGKEKIQWTKDIPITQKATVKKYVITLNGQKAGEVKEGEAGYPCFAHCLSKKEND

SEQ ID NO: 10370 - protein, 143 aa, unidentified
  REGION 1..143: note = Description of Unknown:uncultivated organism sequence
SILGVPKYYCVEVYTNSEGQTQIWGLRFVDMISYEGKLYLKDGVRPADYARHVMYLFPGEYIEVEKKGKIVYEGTYQNVFNINQGKLRIKVKNTNALKTISIGNKAGVFKYAISLNGRKSGVVKEGEAGYPCFAHCLSKKEND

SEQ ID NO: 10371 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 10372 - protein, 143 aa, unidentified
  REGION 1..143: note = Description of Unknown:uncultivated organism sequence
SILGVPKYYCVEVYTNDKGQTKIWGLRFVDMVSYERKLYLKDGVRPADYARHVMYLFPGEYIEVAKNGKIVYEGIYQNVYAINEGRLRIKVKNTNALKPIRIGNKIEVFKYTITLNGCKSGEVQEGEAGYPCFAHCLSKKEND

SEQ ID NO: 10373 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYSCFAHCLLKKEND

SEQ ID NO: 10374 - protein, 136 aa, unidentified
  REGION 1..136: note = Description of Unknown:uncultivated organism sequence
TALPANLYYCIEVYKDVQGATQLRGVRFVDLVKRDKKLWLRYAYPEDYKSHVMYLFANDYIRIFNSKGVVKFEGYYKSVKSIFRNYIYAKNNNSNSAVAIGIAKKDTVKKFDVDILGKIGGEVQCSAPFMLLPENV

SEQ ID NO: 10375 - protein, 143 aa, unidentified
  REGION 1..143: note = Description of Unknown:uncultivated organism sequence
SILGIRKYYCAEVYEDNKGKTRTWGLRYVDMVKRECKLYLKDNVLPKDYVKHVTYLFKGDYIVVYKKDEKIFEGYYKSVEAINNNRFNGFGGNNSKSIGLSIGSNCRVEKYQIDLLGRKCGRIDESRGDYPCFVPLSSKKKKS

SEQ ID NO: 10376 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHVMYLFPGEYIEVEKKGKIVYEGTYRNVYNINQGVLSIKVKNTNALKPISIGNKAGVFKYAISLNGRKSGMVKEGEAGYPCFAHCLSKKEND

SEQ ID NO: 10377 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHMMYLFPGEYIEVEKKGKIVYEGTYQNVYSINQGVLRIKVKNTNALKPISIGNKAGVFKYAISLNGCKSGAVKEGEAGYPCFAHCLSKKEND

SEQ ID NO: 10378 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHMMYLFPGEYIEVEKKGKIVYEGTYQNVYSINQGVLRIKVKNTNALKSISIGNKAGVFKYAISLNGCKSGAVKEGEAGYPCFAHCLSKKEND

SEQ ID NO: 10379 - protein, 143 aa, unidentified
  REGION 1..143: note = Description of Unknown:uncultivated organism sequence
SILGMPKYYCVEVYTNSKGQTQIWGLRFVDMISYEGKLYLKDGVRPADYARHVMYLFPGEYIEIEKKGKIVYEGTYQNVYNINEGRLRVKVKNTNALKPISIGNKVGVFKYAISLNGYKSGVVKEGEAGYPCFAHCLSKKEND

SEQ ID NO: 10380 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYSCFAHCLLKKEND

SEQ ID NO: 10381 - protein, 156 aa, unidentified
  REGION 1..156: note = Description of Unknown:uncultivated organism sequence
SILGVPKYYCVEVYKDTKGKTRIWGIRYVDVISCEGKICLKDDIKLPKKYAKHLIYLFSGEYFEVTEDGKETYVGFYQSVKAATQSKINITINPGKKGKGNDGKEKIQWTKVIPITQKATVKKYVITLNGQKAGEVKEGEAGYPCFAHCLSRKEND

SEQ ID NO: 10382 - protein, 156 aa, unidentified
  REGION 1..156: note = Description of Unknown:uncultivated organism sequence
SILGVPKYYCVEVYKDTKGKTRMWGIRYVDVISCEGKICLKDDIKLPKKYAKHLIYLFSGEYLEVTEDGKETYVGFYQSVKAATQSKINITINPGKKGKGNDGKEKIQWTKVIPITQKATVKKYVITLNGQKAGEVKEGEAGYPCFAHCLSKKEND

SEQ ID NO: 10383 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHGMYLFPGEYIEVEKRGKIVYEGTYQNVYSINQGVLRIKVKNTNALKPISIGNKAGVFKYAISLNGCKSGAVKEGEAGYPCFAHCLSKKEND

SEQ ID NO: 10384 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHVMYLFPGEYIEVEKKGKIVYEGTYQNVYSINQGVLRIKVKNTNALKPISIGNKAGVFKYAISLNGCKSGAVKEGEAGYPCFAHCLSKKEND

SEQ ID NO: 10385 - protein, 156 aa, unidentified
  REGION 1..156: note = Description of Unknown:uncultivated organism sequence
SILGVPKYYCVEVYKDTKGKTRIWGIRYVDVISCEGKICLKDDIKLPKKYAKHLIYLFSGEYLEVTEDGKETYVGFYQSVKAATQSKINITINPGKKGKGNDGKEKIQWTKVIPITQKATVKKYVITLNGQKAGEVKEGEAGYPCFAHCLSRKEND

SEQ ID NO: 10386 - protein, 25 aa, unidentified
  REGION 1..25: note = Description of Unknown:uncultivated organism sequence
SILGVPKYYCVEVYKDTKGKNLLKR

SEQ ID NO: 10387 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYGGTYQNVFNINQGKLRIKVKNTNALKTISIGNKAGVFKYAISLNGCKSGVVKEGEVGYPCFAHCLSKKEND

SEQ ID NO: 10388 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARYVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 10389 - protein, 143 aa, unidentified
  REGION 1..143: note = Description of Unknown:uncultivated organism sequence
SILGVPKYYCVEVYTNSKGQTKIWGLRFVDMISYEGKLYMKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKKEND

SEQ ID NO: 10390 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYEGTYQNVYNINQGVLSIKVKNTNALKPISIGNKAGVFKYAISLNGCKSGMVKEGEAGYPCFAHCLLKKEND

SEQ ID NO: 10391 - protein, 136 aa, unidentified
  REGION 1..136: note = Description of Unknown:uncultivated organism sequence
NYYDSSNYYCIELYETTDGKNNLRGIRYADLRKQDKKLYLTAENPADYKQHKMYLFANDYIEVIGGKGNLKFSGYYKSVFNINQNIFYIAIKNNNKAIPKFIGQKDTIKKHSVDILGQMGGEVKCSAPFMLLREKK

SEQ ID NO: 10392 - protein, 143 aa, unidentified
  REGION 1..143: note = Description of Unknown:uncultivated organism sequence
SILGVPKYYCVEVYTNSKGQTQIWGLRFVDMISYEGKLYLKDGVRPADYARHVMYLFPGEYIEVEKKGKIVYGGTYQNVFNINQGKLRIKVKNTNALKTISIGNKAGVFKYAISLNGCKSGVVKEGEAGYPCFAHCLSKKEND

SEQ ID NO: 10393 - protein, 143 aa, unidentified
  REGION 1..143: note = Description of Unknown:uncultivated organism sequence
SILGVPKYYCVEVYTNSKGQAKIWGLRFVDMISYEGKLYLKDGVRPADYARHVMYLFPGEYIEVEKKGKIVYEGTYQNVYNINQGVLSIKVKNTNALKPISIGNKAGVFKYAISLHGCKSGEVKEGEAGYPCFAHCLSKKEND

SEQ ID NO: 10394 - protein, 143 aa, unidentified
  REGION 1..143: note = Description of Unknown:uncultivated organism sequence
SILGMPKYYCVEVYTNSKGQTQIWGLRFVDMISYEGKLYLKDGVRPADYARHVMYLFPGEYIEIEKKGKIVYEGTYQNVYNINEGRLRVKVKNTNALKPISIGNKVGVFKYAISLNGCKSGVVKEGEAGYPCFAHCLSKKEND

SEQ ID NO: 10395 - protein, 136 aa, unidentified
  REGION 1..136: note = Description of Unknown:uncultivated organism sequence
NYYDAASYYCVELYETTDGKNNLRGIRYADLRKQNKKLYLTAENPADYKQHKMYLFANDYIKIIDSKGELKFRGYYRKVHNINRGVFYCLNNNDSQRIDCSIGKKDIVQKYSVNILGQIGGEVKCSAPFMLRREKK

SEQ ID NO: 10396 - protein, 143 aa, unidentified
  REGION 1..143: note = Description of Unknown:uncultivated organism sequence
SILGVPKYYCVEVYTTSKGQTKIWGLRFVDMISYEGKLYLKDGVRPADYARHVMYLFPGEYIEVEKKGKIVYEGTYQNVYNINQGVLRIKVKNTNALKPISIGDKAGVFKYAISLNGCKSGVVKEGEAGYPCFAHCLLKKEND

SEQ ID NO: 10397 - protein, 143 aa, unidentified
  REGION 1..143: note = Description of Unknown:uncultivated organism sequence
SILGVPKYYCVEVYTNSKGQTKIWGLRFVDMISYEGKLYLKDGVRPADYARHVMYLFPGEYIEVEKKGKIVYEGTYQNVYNINQGVLRIKVKNTNALKPISIGDKAGVFKYTISLNGCKSGVVKEGEAGYPCFAHCLLKKEND

SEQ ID NO: 10398 - protein, 136 aa, unidentified
  REGION 1..136: note = Description of Unknown:uncultivated organism sequence
NILTASKYYCIELYETTDGKNNLRGIRYADLRKQDKKLYLTAENPADYKQHKMYLFANDYVKVIDGKGKLKFIGYYKSVHNINTRRLWMNNNNSNSSCDLTISAKDILKKYNVDILGQIGGEIKCSAPFMLLREKK

SEQ ID NO: 10399 - protein, 136 aa, unidentified
  REGION 1..136: note = Description of Unknown:uncultivated organism sequence
NVLDAKKYYCVEIYEDIKDKTSLRGIRYVDLKKQNKKLYLVSSKPADYKKHVMYLFANDYIEVFSDDGNLKFKGYYKSVEAITRNLLTYKFNNSTKELHKRIGKKDIVKKYYVDILGKIGGEIKCSVPFLSLKDNI

SEQ ID NO: 10400 - protein, 136 aa, unidentified
  REGION 1..136: note = Description of Unknown:uncultivated organism sequence
SILDARNYYCLELYKNIDDGISLRGIRYVDLKKQYKKLCINVSCPKDYKNHIMYLFNNDYIAIFDKNNNLKFNGYYKGLKSVNNRFIYVKNNNSNLSEYKTIGKKDIIKKYYVDILGKIGGEIKCSVPFLSLKDNI

SEQ ID NO: 10401 - protein, 136 aa, unidentified
  REGION 1..136: note = Description of Unknown:uncultivated organism sequence
NILTASKYYCIELYETTDGKNNLRGIRYADLRKQDKKLYLTAENPADYKQHKMYLFANDYIEVINKKGECKFKGFYKSVYNINENRISCNEDNNSKSINKTIAAQDVIKKYNIDILGQIGGEVKCSAPFMLLREKK

SEQ ID NO: 10402 - protein, 140 aa, unidentified
  REGION 1..140: note = Description of Unknown:uncultivated organism sequence
SILGVPKYYCVEVYTNSKGQTKIWGLRFVDMISYEGKLYMKDGVRPADYARHVMYLFPGEYIEVEKKGKIVYEGTYQNVYNINQGVLSIKVKNTNALKPISIGNKAGVFKYAISLNGRKSGMVKEGEAGYPCFAHCLSKK

SEQ ID NO: 10403 - protein, 143 aa, unidentified
  REGION 1..143: note = Description of Unknown:uncultivated organism sequence
SILGVPKYYCVEVYTNDKGQTKIWGLRFVDMISYEGKLYLKDGVRPADYARHVMYLFPGEYIEVEKKGKIVYEGTYQNVYSINQGKLSIKVKNTNALKTISIGNKAGVFKYAISLNGRKSGAVKEGEAGYPCFAHCLSKKEND

SEQ ID NO: 10404 - protein, 139 aa, unidentified
  REGION 1..139: note = Description of Unknown:uncultivated organism sequence
TNLSSLKYYCVEVYKDLSGKTRTCGIRFVDLKKKDKKLYRKADSIPEGYGTHVMYLFPNDYIVIKDKGGEVKCSGFYQSVYNINRGIFYFKSINKPAIICKSIALQDKVEKRAVSILGQIGGEVRCSAPLPYIGEKSSR

SEQ ID NO: 10405 - protein, 145 aa, unidentified
  REGION 1..145: note = Description of Unknown:uncultivated organism sequence
SNLGGLKYYCVEVYRDLDGYTRIRGVRFVDVVRKNKKLYIRAETIPEGYAAHIMYLFPGDYIVVLNTLDKSVKYQGTYKSVYNINQSRLTYYRGNSSKDSDFCLNKKDTMTKYELSLLGRKGGEIKCSAPLSLIGENESESGITG

SEQ ID NO: 10406 - protein, 145 aa, unidentified
  REGION 1..145: note = Description of Unknown:uncultivated organism sequence
SNIGGLKYYCVEVYRDKEGYTRIRGVRFVDVVRKNKKLYIRAETIPEDYAEHIMYLFPGDYIEIYNSADKTFKNKGVYRSVYDINASRLCYYTSNIAGISNFTLNKRDIIRKYDLSILGMKGGEIKCSAPLSLIGANESESRTIG

SEQ ID NO: 10407 - protein, 139 aa, unidentified
  REGION 1..139: note = Description of Unknown:uncultivated organism sequence
TVLGMLKYYCVEVYKDKEGNTAVCGVRFVDVSKKGKKLYRKAESIPADYAEHVTYLFPGDYIRVIDRKGKLKFEGYYVAVYNINQSVFYCRVGNMSDTVAKSISRRDTVTKVYVDILGKIGGEVKCSEPLPCIPEKRSR

SEQ ID NO: 10408 - protein, 136 aa, unidentified
  REGION 1..136: note = Description of Unknown:uncultivated organism sequence
TNMSMLKYYCVEVYKNKKGETKTWGIRYVDIIKRDKKLYLKKVMLPEDYAEHRMYLFTNDAITVYNKSGEKKYEGFYKSVKNINRSSFYIGDYIKDEVKPEQINRTDTVKKLDISILGKRGGGIACSAPLSLTPEK

SEQ ID NO: 10409 - protein, 139 aa, unidentified
  REGION 1..139: note = Description of Unknown:uncultivated organism sequence
TNLSMLKYYCVEVYQDLDGKTRIYGIRYVDMIRRNKKLYQKAESYPSDYGKHETYLFPNDYVQILNGKNEVKFEGYYRAVKAIKQCQLWFRKPNSREMVKKSIASNDRVSRVDVSILGKKGGEICCSEPFPSIGEKESR

SEQ ID NO: 10410 - protein, 137 aa, unidentified
  REGION 1..137: note = Description of Unknown:uncultivated organism sequence
TAINANKYYCIEVYKTKKGKVNIRGIRYVDLVKKDKKLHLRISYPDDYQQHVTYLFANDYVRIFDVVSGMQKFEGYYKSIKTIGRKQLYFTKNNRQQTDIITINQTDDVKKFVVDILGKIGGEVKCSVPLPLLVGKQ

SEQ ID NO: 10411 - protein, 137 aa, unidentified
  REGION 1..137: note = Description of Unknown:uncultivated organism sequence
TAINANKYYCIEVYKTKKGKVNIRGIRYVDLVKKNKKLHLRISYPDDYQQHVTYLFANDYVRIFDVVSGMQKFEGYYKSIKTIGRKQLYFTKNNRQQTDIITINQTDDVKKFVVDILGKIGGEVKCSVPLPLLVGKQ

SEQ ID NO: 10412 - protein, 139 aa, unidentified
  REGION 1..139: note = Description of Unknown:uncultivated organism sequence
SLLDANKYYCVEVYKNLAGKTCTWGLKFVDLVKNDKKLWLKPGSLPSDYGKHITYLFANDYIQIFNKKGEVKFEGFYKGVYNVNQNSFYYAKGNEPRKTGKSITIARHDTVKKYHIDILGRQGGEIKCSAPLSLLTENP

SEQ ID NO: 10413 - protein, 142 aa, unidentified
  REGION 1..142: note = Description of Unknown:uncultivated organism sequence
LKLLDMDAKKMLVGDEPRYVIKTNRNKEEKLVIDKEKNVELYGYLKNKLCDKIYSGLSAFATFAKNIENGKEKFIDLTIVEQAKVLIQILMMFKRKDILSDLTLIGGSSHSGKILFNKKIDDVNFEIIHLSPAGLRVIKNKV

SEQ ID NO: 10414 - protein, 168 aa, unidentified
  REGION 1..168: note = Description of Unknown:uncultivated organism sequence
SLVNEKINKDFIKRKTDKGDLSDDEFRRKLFVEQEEEKTRRENDPEQKNKSKILHVTKEKNNELYNLFLDKVTNEKSPYAYLPAYTSFKNTLEKGKEIFYQMDEYDGLRCLLNLIVAFQCNAKTVDASCIGGSKEICRISTTKEITNMHVTFISQSVTGLKEKRIKIN

SEQ ID NO: 10415 - protein, 146 aa, unidentified
  REGION 1..146: note = Description of Unknown:uncultivated organism sequence
ESFERKVKLNDKKVNFVYDEKKSGFSEQDLTNLFSELKSKVENTFFNCLPAVITNVLKNIDLQTYRVKEKDSDERLLTIEQKVHVVVELLKAFQSNGASSDLHDIGESKNSGIVRTTELDFEKYSIINYSVTGFYFIETKLRDLIK

SEQ ID NO: 10416 - protein, 142 aa, unidentified
  REGION 1..142: note = Description of Unknown:uncultivated organism sequence
LKLLDMNKAGTIKEENGEYIIKTNRNKDRKLVINRESNTALYEELKNRLNKPIYQGLSPFTTFRNNLEKGKEKFENLSVLEQSEVLAQILRFFKCDADKSDLTLIGGSGKSGTIVFNKDITLVDFKIISKSPAGLTERIKTV

SEQ ID NO: 10417 - protein, 142 aa, unidentified
  REGION 1..142: note = Description of Unknown:uncultivated organism sequence
LKVAEMDKNQTCDKDAETYLIKTNRFKEVKLEVNKQNNIALYDEFINRLSSGLYGKMGSAISYLTNLQSGREIFINLTTLNQSLALLQTLKFFKCNAEMADLSLIGGASHAGKIYISRDITKAEVVLVHQSPCGLTLREQKI

SEQ ID NO: 10418 - protein, 179 aa, unidentified
  REGION 1..179: note = Description of Unknown:uncultivated organism sequence
SKVIKSLIDKKELQFDGENIVVIQNRFGDKKLVTKEKNLALYKELVKHLNKAIYKKVSIGAIGRRLKDTYDTFKGLDCVKQVETIKGLLDVINGVSGGDLTSVGESKTCGTLTVNKNINVPISIINYSPTGFYEKEIKLNWWDLEPWWLTHIANLNWDLIIWYAKANKFSVCFWMKFPP

SEQ ID NO: 10419 - protein, 154 aa, unidentified
  REGION 1..154: note = Description of Unknown:uncultivated organism sequence
SKVIKSLIDKKELQFDGENIVVIQNRFGDKKLVTKEKNLALYKELVKHLNKAIYKKVSIGAIGRRLKDTYDTFKGLDCVKQVETIKGLLDVINGSNGGNLENVGESKNCGTIKINKNINVPISIINYSPTGFYEKEIKLNWWDLEPWWLTHIAS

SEQ ID NO: 10420 - protein, 140 aa, unidentified
  REGION 1..140: note = Description of Unknown:uncultivated organism sequence
SKIIKNITDKKELQYEGDNIIVVQNRFGEKKLITKEQNLILYKELVKHFNKAIYKNVSIGEIGKKLKDTYTIFYNLDCEKQIETINGLLNVLNGSSGGNLTNVGESKNSGVLVLSKTINIPISIINFSPTGFYKKEIKLN

SEQ ID NO: 10421 - protein, 154 aa, unidentified
  REGION 1..154: note = Description of Unknown:uncultivated organism sequence
SKAIKSLVDKKELQFDGENIVVIQNRFGDKKLVTKEKNLALYKELVKHLNKAIYKNVSIGAIGKRLKDTYDTFKDLDCVKQIETIKGLLDVINGSNGGNLANVGESKNSGALTVNKNINVPISIINYSPTGFYEKEIKLNWWDLEPWWLTHIAS

SEQ ID NO: 10422 - protein, 149 aa, unidentified
  REGION 1..149: note = Description of Unknown:uncultivated organism sequence
SKVIKSLIDKKELQFDGENIVVIQNRFGDKKLVTKEKNLALYKELVKHLNKAIYKNVSITTIAKRLKTTYDTFKGLDCVKQIGTIKGLLDVINGASGGDLTSVGESKTCGKILVSKIIKEQQISIINYSPTGFYEKEIKLNWWDLELWW

SEQ ID NO: 10423 - protein, 143 aa, unidentified
  REGION 1..143: note = Description of Unknown:uncultivated organism sequence
EKYLSMSDSTKEKLAKADDYIVVSPGIKDKTQEVRITRQENIELYDLVIRQLKKKIYNISSIKGVLNTLENSRRKFNLLNLDEQVKQLNNIIRYLGGSYSVDLILLGGVGRAGATTIGKNITDLDVKVIVQSASGLKRKEIKL

SEQ ID NO: 10424 - protein, 142 aa, unidentified
  REGION 1..142: note = Description of Unknown:uncultivated organism sequence
LKLADMKAKGVINVGQEEFVMKTNRGGERKLVIDRANNADLYGMLKRKLERKNYAGLSAFATFRKNLEKGEKKFNSLTVYEQTVVLLQILKFFKCNAETADITLIGGSGRSGVISINKSVTDVDFRLIDLSPAGLTERVRKV

SEQ ID NO: 10425 - protein, 142 aa, unidentified
  REGION 1..142: note = Description of Unknown:uncultivated organism sequence
SKLVEMAKNGTISEENGEYIIKTNRNKDVKLTINRQSNIELYDTLKNKLSKPSYQGLSPFSTFRKNLESGEEKFANLSVVDQCTVLLQILKFFKCNAETADIVLIGGSKISGKILFNKDIAGVNFEIVSKSPAGLTERIKKV

SEQ ID NO: 10426 - protein, 142 aa, unidentified
  REGION 1..142: note = Description of Unknown:uncultivated organism sequence
KKLLDMNKEVKQKPESEEFVMKTNNEGVRKLVITRQSNIEKYDLLAAQLGKDFYQVLSPFRNVKKIIDEGKKKFCELLVIDQCYVLMQILSYLQCKGATADLQLIGGSGRSGQIRFNKDITNVDFRIYDTSSTGLFVKESKA

SEQ ID NO: 10427 - protein, 142 aa, unidentified
  REGION 1..142: note = Description of Unknown:uncultivated organism sequence
LKLADMKTKGVINVGQEEFVMKTNRDGERKLVIDRANNADLYDMLKRKLKRENYAGLSAFATFRKNLEKGEEKFNSLTVYEQTVVLLQILKFFKCNAETADTTLVGGSAKSGKILINNNITNVDFRLIDLSPAGLTERVRKV

SEQ ID NO: 10428 - protein, 142 aa, unidentified
  REGION 1..142: note = Description of Unknown:uncultivated organism sequence
LKIVDMDAKKMLVGDEPRYVTKTNRYKKEKVVIDKEKNLELYCRLKDKLSDKIYSGLSAFSTFAKNMESGEEKFKELAIVEQAKTLIQILKMFKCNAETSDLKFIGGSSRSGTVYINKKIDGVNFEIIHLSPAGLRVIKNKV

SEQ ID NO: 10429 - protein, 142 aa, unidentified
  REGION 1..142: note = Description of Unknown:uncultivated organism sequence
SKLVEMAKNGTISEENGEYIIKTNRNKDVKLTINRQSNIELYDTFKDRLSKPIYQGLSPFSTFRKNLESGEEKFANLSVTDQCTVLLQILKFFKCNADTADISLIGGGETCGRIRFNKDISKVNFEIVCKSPAGLTERIKKV

SEQ ID NO: 10430 - protein, 133 aa, unidentified
  REGION 1..133: note = Description of Unknown:uncultivated organism sequence
VSFLKKLKEDNSYQYSPKFAGFSDSELNELLNILKWKIINTKFKNISDSVTKLLKATQFDENLVLSIPDKAKLVMNLVGFFENRDHFNDLSLIGGKKQMGRLLKSIKPKGDFSIVYQSVTGFYVHEIKLNELK

SEQ ID NO: 10431 - protein, 142 aa, unidentified
  REGION 1..142: note = Description of Unknown:uncultivated organism sequence
SKLVEMAKNGIISEENGEYIIKTNRNKDVKLTINRQSNIELYDTLKDRLSKPIYQGLSPFSTFRKNLESGEEKFANLSVTDQCTVLLQILKFFKCNADTADISLIGGGETCGRIRFNKDISKVNFEIVCKSPAGLTERIKKV

SEQ ID NO: 10432 - protein, 142 aa, unidentified
  REGION 1..142: note = Description of Unknown:uncultivated organism sequence
KKLLDMNKTVKQKTESEEFVMKTNNDGVRKLVITRQSNIEKYEMLVAQLDKDFYQGIPPFRNVKKIIDEGKKKFCELLVIDQCYVLMQILSYLQCKGATADLQLIGGSGRSGQIRFNKDITNVDFRIYDTSPTGLFVKESKA

SEQ ID NO: 10433 - protein, 142 aa, unidentified
  REGION 1..142: note = Description of Unknown:uncultivated organism sequence
SKLVEMAKNGTISEENGEYIIKTNRNKDVKLTINKHSNIELYDTLKNKLSKPSYQGLSPFSTFRKNLEGGEEKFANLSVADQCTVLLQILKFFKCNAETADIVLIGGSGRSGCILFNKDVSKADIKIICKSPAGLTERIKKV

SEQ ID NO: 10434 - protein, 151 aa, unidentified
  REGION 1..151: note = Description of Unknown:uncultivated organism sequence
VKLLEMAKNPMFDVNCEKYELTPNRERGEKITIDRDSNIKLYDFLLKKFDSEGDAKNKINKRFQGISSYLAFGQNLKSGREKFVSLTVLQQVNVLSQVMKFFRCNADTADIELIGGSKGSGKILFNQNITDVDFRIISQSPCGLTVHVKRV

SEQ ID NO: 10435 - protein, 133 aa, unidentified
  REGION 1..133: note = Description of Unknown:uncultivated organism sequence
VSFLKKLNEDNSYQYSPKFAGFSDSELNELLNILKWKITNTKFKNISDKVTSLLEATQFDENLVLSIPDKAKLVMNLVGIFENRDHSNDLSLIGGKKQMGRLLKSIKPNGDFSIVYQSVTGFYVHEIKLNELK

SEQ ID NO: 10436 - protein, 141 aa, unidentified
  REGION 1..141: note = Description of Unknown:uncultivated organism sequence
SKTVKLMNDKKELNIEDGNIVVEQNRFGEKSLLIKEENMKLYKELIKHLNKSIYKCISLGKIGKDLKNTYEIFENVDIVEQVKTIKGLLDIINGVSGGDITNVGGSKNSGLISFSKTLSKNPVSIINSSPTGFYQKEFKLV

SEQ ID NO: 10437 - protein, 142 aa, unidentified
  REGION 1..142: note = Description of Unknown:uncultivated organism sequence
LKLADMKAKSIINVGQEEFVMKTNRDGERKLVIDRANNADLYGMLKRKLERENYAGLSAFATFRKNLEKGEEKFNSLTVYEQTVVLLQILKFFKCNAETADISSIGGGKIVGKIYVNINITNVDFRLIDLSPAGLTERVRKV

SEQ ID NO: 10438 - protein, 136 aa, unidentified
  REGION 1..136: note = Description of Unknown:uncultivated organism sequence
VSFLKKLQEDNSYQYSPKFAGFSDSELNELLNILKWKIINTKFKNISKPVTKLLIKAPQFDENLVLSIPDKAQLVMNLVGIFKNSYSSKGNDFSLIGGKKKMGSLLKSIKPEDDFSIVYKSVTGFYVHEIKLNELK

SEQ ID NO: 10439 - protein, 133 aa, unidentified
  REGION 1..133: note = Description of Unknown:uncultivated organism sequence
VSFLKKLQEDNSYQYSPKFAGFSDSELNELLNILKWKITNTKFKNISEPVTKLLEATQFDENLVLSIPDKAKLVMNLVGIFENRDHTNDLSLIGGKKEMGRLRKSIKPKGDFSIVYQSVTGFYVHEIKLNELK

SEQ ID NO: 10440 - protein, 141 aa, unidentified
  REGION 1..141: note = Description of Unknown:uncultivated organism sequence
SKTVKLMNDKKELNIEDGNIVVEQNRFGEKSLLTKEENMKLYKELIKHLNKSIYKCISLGKIGKDLKNTYEIFENVDIVEQVKTIKGLLDIINGVSGGDITNVGGSKNSGLISFSKTLSKNPVSIINSSPTGFYQKEFKLV

SEQ ID NO: 10441 - protein, 142 aa, unidentified
  REGION 1..142: note = Description of Unknown:uncultivated organism sequence
LKIVEMQSKNMLDLYSDSLVMKTNSAGDEKLVVDKNKNLELYQRLTNKLNEKIYSGISAFSSFKNNLLNGEEKFAELELPEQAKVIIQILKFFKCNAETSDLTSIGGAKGSGSIKFNKNITDVDFRLINRSPAGLTEKVRRV

SEQ ID NO: 10442 - protein, 142 aa, unidentified
  REGION 1..142: note = Description of Unknown:uncultivated organism sequence
LKIVDMDAKKMLVGDEPRYVTKTNRYKKEKVVIDKEKNLELYSRLKDKLSDKIYSGLSAFSTFAKNMESGEEKFKELAIVEQAKTLIQILKMFKCNAETSDLKFIGGSSRSGTVSINKKIDGVKLEIIHLSPAGLRVIKNKV

SEQ ID NO: 10443 - protein, 142 aa, unidentified
  REGION 1..142: note = Description of Unknown:uncultivated organism sequence
SKLIEMSKNGTISEENGEYIIKTNRNKDVKLTINRQSNIELYDTLKNRLSKSSFQGLSSFSTFKSNLTNGEEKFTKLPIIDQCVVLLQILKFFKCNAETANISLIGGGETCGRLYLNKNITDAKFDIICKSPAGLTERIKKV

SEQ ID NO: 10444 - protein, 133 aa, unidentified
  REGION 1..133: note = Description of Unknown:uncultivated organism sequence
VSFLKKLKEDNSYQYSPKFAGFSDSELNELLNILKWKIINTKFKNISDSVTKLLKATQFDENLVLSIPDKAKLVMNLVGIFENRDHFNDLSLIGGKKQMGRLLKSIKPKGDFSIVYQSVTGFYVHEIKLNELK

SEQ ID NO: 10445 - protein, 148 aa, unidentified
  REGION 1..148: note = Description of Unknown:uncultivated organism sequence
SKFFSLSNANVTMDISRDKIVVSPAKSKNGKELSLTKEENIQIYKKIADYVNTDMYSVITKGEISKILNEKIEGFSNLEMVEQSKFLYGMVTTISNRGNLIWKLDAIGRSGQLTNYRINKNVTGKGYKLVKRNVLGYVIYQQDLENVR

SEQ ID NO: 10446 - protein, 149 aa, unidentified
  REGION 1..149: note = Description of Unknown:uncultivated organism sequence
LKLLEMDKNGLVDKNASEYVMKTNRMGDVKLVVDKAHNESLYDCFVEKLQKNEQDKVSLKYGNLSPFVTFGKNLQNGKEKFTNLTTLEQSYVIVQILRFFKCDAQTADIQLVGGSSMSGKVLFNKDITDVDFRLVDQSPCGLIVRTRKL

SEQ ID NO: 10447 - protein, 142 aa, unidentified
  REGION 1..142: note = Description of Unknown:uncultivated organism sequence
VKLLEMAKNPTFDVNCEKYELTPNRERGEKITIDRESNIKLYDFFLSKFDCSKFKGVSSYVTFGKNLSIGREKFVALTVSQQVNVLNQIVNFFKCNAETADIELIGGSKISGKILFNKNITDVDFRIISQSPCGLTVHVKRV

SEQ ID NO: 10448 - protein, 109 aa, unidentified
  REGION 1..109: note = Description of Unknown:uncultivated organism sequence
SKLVEMAKNGTISEENGEYIIKTNRNKDVKLTINRQSNIELYDTLKNKLSKPSYQGLSPFSTFRKNLESGEEKFANLSVTDQCTVLFQIEFYDCAWRKRKTYLAASDCV

SEQ ID NO: 10449 - protein, 142 aa, unidentified
  REGION 1..142: note = Description of Unknown:uncultivated organism sequence
LKLADMKAKGVINVGQEEFVMKTNRDGERKLVIDRANNADLYDMLKRKLERENYAGLSAFATFRKNLEKGEEKFNSLTVYEQTVVLLQILKFFKCNAETADTTLVGGSAKSGSIKFNNNITNVDFRLIDLSPAGLTERVRKV

SEQ ID NO: 10450 - protein, 142 aa, unidentified
  REGION 1..142: note = Description of Unknown:uncultivated organism sequence
LKLADMKAKGIINVGQEEFVMKTNRDGERKLVIDRANNADLYGMLKRKLERENYAGLSAFATFRKNLEKGEEKFNSLTVYEQTVVLLQILKFFKCNAETADTTLVGGSAKSGSIKFNNNITNVDFRLIGLSPAGLTERVRRV

SEQ ID NO: 10451 - protein, 142 aa, unidentified
  REGION 1..142: note = Description of Unknown:uncultivated organism sequence
LKLLEMDKNGLVDKNASEYVMKTNRMGDVKLVVDKAHNENLYNCFVEKLQGGKYGKLSSFVTFGKNLQSGKEKFTNLTTLEQSYVIVQILRFFKCDGQEADIRLIGGSEQSGSIKFGNGITDVDFRLVDQSPCGLTVRTRKL

SEQ ID NO: 10452 - protein, 142 aa, unidentified
  REGION 1..142: note = Description of Unknown:uncultivated organism sequence
LKLADMKAKGIINVGQEEFVMKTNRDGERKLVIDRANNADLYDMLKRKLERENYAGLSAFATFRKNLEKGEEKFNSLTVYEQTGVLLQILKFFKCNAETADTTLVGGSAKSGSIKFNNNITNVDFRLIDLSPAGLTERVRKV

SEQ ID NO: 10453 - protein, 142 aa, unidentified
  REGION 1..142: note = Description of Unknown:uncultivated organism sequence
LKLADMKAKGIINVGQEEFVMKTNRDGERKLVVDRANNADLYGMFKRKLERENYAGLSAFATFRKNLEKGEEKFNSLTVYEQTVVLLQILKFFKCNAETADTTLVGGSAKSGKILINNNITNVDFRLIDLSPAGLTERVRKV

SEQ ID NO: 10454 - protein, 142 aa, unidentified
  REGION 1..142: note = Description of Unknown:uncultivated organism sequence
SKLVEMAKNGTISEENGEYIIKTNRNKDVKLTINRQSNIELYDTLKNRLLKSNFQGLPSFSTFRKNLENGENNFVNLSLTDQCSVLLQLLKFFKCNAETADISLIGGGGRSGTLYLNKDISKVDFKIICKSPAGLTERIKKV

SEQ ID NO: 10455 - protein, 142 aa, unidentified
  REGION 1..142: note = Description of Unknown:uncultivated organism sequence
LKLLDMNSKNMVAHDETEYVIKTNRNGERKLVITKESNIKLYDVLRNKLDSDIYSGISAFKTFKGNLDNSSVIFAELNIIDQAKVIIQVLKVFKNNAETADIRLIGGGPQSCRIQINKNITDVDFKIIDLSPAGLTRRIRKV

SEQ ID NO: 10456 - protein, 142 aa, unidentified
  REGION 1..142: note = Description of Unknown:uncultivated organism sequence
SKLVEIAKSGTITEENGEYIIKTNRNKDVKLTINRQSNIELYDTLKNKLSKPSYQGLSPFSTFRKNLESGEEKFANLSVTNQCTVLLQILKFFKCNAELANISLIGGGKGSGRILFNKDITNADFKIICKSPAGLTERIKKV

SEQ ID NO: 10457 - protein, 142 aa, unidentified
  REGION 1..142: note = Description of Unknown:uncultivated organism sequence
LKLADMKAKGIINVGQEEFVMKTNRDGERKLVIDRANNADLYGMLKRKLERENYAGLSAFATFRKNLEKGEEKFNSLTVYEQTVVLLQILKFFKCNAETADISSIGGGKIVGKIYVNINITNIDFRLIDLSPAGLTERVRKV

SEQ ID NO: 10458 - protein, 22 aa, unidentified
  REGION 1..22: note = Description of Unknown:uncultivated organism sequence
LKIVEMAKQPTFNKNSDCYGGY

SEQ ID NO: 10459 - protein, 142 aa, unidentified
  REGION 1..142: note = Description of Unknown:uncultivated organism sequence
LKIVDMDAKKMLVGDEPRYVTKTNRYKKEKVVIDKEKNLELYSRLKDKLSDKIYSGLSAFSTFAKNMESGEEKFKELAIVEQAKTLIQILKMFKCNAETSDLKFIGGSSRSGTVSINKKIDGVNFEIIHLSPAGLRVIKNKV

SEQ ID NO: 10460 - protein, 142 aa, unidentified
  REGION 1..142: note = Description of Unknown:uncultivated organism sequence
LKLADMKAKGVINVGQEEFVMKTNRDGERKLVIDRANNADLYGMLKRKLERENYAGLSAFATFRKNLEKGEEKFNSLTVYEQTVVLLQILKFFKCNAETADITLIGGSGRSGVISINKSVTDVDFRLIDLSPAGLIERVRKV

SEQ ID NO: 10461 - protein, 142 aa, unidentified
  REGION 1..142: note = Description of Unknown:uncultivated organism sequence
LKIVEMAKQPTFNKNSDCYIVKTNRMGDIKLVVDKGSNVKLYDELILKLECKQFQGFGAYTSFRNVLTESREKFVDLSTLEQAIVLLEVLKFFKNNADTADLSLIGESKRAGILRFSKNITDVDFRIISQSPCGLTVHIKRV

SEQ ID NO: 10462 - protein, 142 aa, unidentified
  REGION 1..142: note = Description of Unknown:uncultivated organism sequence
LNLEDMKSKKAVNVGDEEFLMKTDHTGAEKLVIDKATNIALYRDLMRRLGLKIYSGISAFATFAKNMENGEDKFISLTVCDQATVLLQILKFFKCNAEISDITLIGGSGKSGTVLLNKNITDVDFEIINLSPAGLIERVRKV

SEQ ID NO: 10463 - protein, 146 aa, unidentified
  REGION 1..146: note = Description of Unknown:uncultivated organism sequence
EKFVSRLKNKSIKIKYEKDKSGFTDEDLSSIYSELKDKSKNSVFKNLPKPIVKMLSDVDINNYKYQESEKSEPKLLTIEQKAVAICELIKTFHTESSNLLFLGEKKGSGVKRIKTVLDLEKTDYSILCSSITGFYEKEIRLRDLLK

SEQ ID NO: 10464 - protein, 143 aa, unidentified
  REGION 1..143: note = Description of Unknown:uncultivated organism sequence
EKYQNMPATIKELLKTTDEEIIVSPAVKTNSKQLAISRTNNVYLYDLIVAQLGKKIYNLSSISGLVKKLTNARSVFLSLSISAQAELLLGLVKYVGGAYNVDLALLGESQHAGSTTIGKNISNLNISLIEQSVTGLYAKETVL

SEQ ID NO: 10465 - protein, 168 aa, unidentified
  REGION 1..168: note = Description of Unknown:uncultivated organism sequence
SLVNEKINKEFIKRKTDKGELSDDEFRRKLFVEQEEEKTRRENDSDQKNKSKILHVTKEKNNELYDLFLDKVSNEKSPYAYLPAYSSFKNTLEKGKEIFYQMDEYNGLRCLLNLIVAFQCNARNVDASNVGGGKYMCNIATSKDITDKSVTFISQSVTGLKEKRIKIN

SEQ ID NO: 10466 - protein, 142 aa, unidentified
  REGION 1..142: note = Description of Unknown:uncultivated organism sequence
LKLADMKAKGVINVGQEEFVMKTNRDGERKLVIDRANNADLYGMLKRKLERENYAGLSAFATFRKNLEKGEEKFNSLTVYEQTVVLLQVLKFFKCNAETADTTLVGGSTKSGSIKFNNNITNVDFRLIDLSPAGLTERVRKV

SEQ ID NO: 10467 - protein, 143 aa, unidentified
  REGION 1..143: note = Description of Unknown:uncultivated organism sequence
EKYKNMPQVAKECLKEDGEKLVVSPAVKENSRPQIITRTQNVELYDLIINQLSKKIYDLSSIKAIVSNLKDKRDLFIALSIPNQTEILLNLVKYVGGGYFADLKLLGGTEYMGATTFGKNITDLNIYLIEQSVTGLYSKGTKL

SEQ ID NO: 10468 - protein, 146 aa, unidentified
  REGION 1..146: note = Description of Unknown:uncultivated organism sequence
DNFVSRLKNKSFEVKYDKDKSGFTEEDLSSIYSELKDKTKNTVLKALPKTTVKILTDVDINSYQYSENEKSEPKLLSIEQKAVAICEVIKAFHTEPSDLSLLGGKANSGKMCINSVLNLDKDDYSVVFYSITGFYEKELRLSDLLK

SEQ ID NO: 10469 - protein, 142 aa, unidentified
  REGION 1..142: note = Description of Unknown:uncultivated organism sequence
LKLADMKAKGIINVGQEEFVMKTNRDGERKLVIDRANNADLYDMLKRKLERENYAGLSAFATFRKNLEKGEEKFNSLTVYEQTVVLLQILKFFKCNAETADTTLVGGSAKSGSIKFNNNITNVDFRLIDLSPAGLTERVRKV

SEQ ID NO: 10470 - protein, 142 aa, unidentified
  REGION 1..142: note = Description of Unknown:uncultivated organism sequence
LKLLDMNSKNMVAHDETEYVIKTNRNGERKLVITKESNIKLYDVLRNKLDSDIYSGISAFKTFKGNLDNSSVIFAELNIIDQAKVIIQVLKALKNNAETADIRLIGGGPQSCRIQINKNITDVDFKIIDLSPAGLTRRIRKV

SEQ ID NO: 10471 - protein, 146 aa, unidentified
  REGION 1..146: note = Description of Unknown:uncultivated organism sequence
EKFVSRLKNKSIKIKYEKDKSGFTDEDLSSIYSELKDKSKNSVFKNLPKPIVKMLSDVDINNYKYQESEKSEPKLLTIEQKAVAICELIKAFHTESSNLLFLGEKKGSGVKRIKTVLDLEKTDYSILCSSITGFYEKEIRLRDLLK

SEQ ID NO: 10472 - protein, 143 aa, unidentified
  REGION 1..143: note = Description of Unknown:uncultivated organism sequence
EKYKNMPQVAKECLKEDGERLIVSPAVKENSRPQIITRTQNVELYDLIINQLSKKIYDLSSIKAIVSNLKDKRDLFIALSIPNQTEVLLNLVKYVGGGYLADLKLLGGTEHMGTTRISKDITDLNIYLIEQSVTGLYSKGTKL

SEQ ID NO: 10473 - protein, 142 aa, unidentified
  REGION 1..142: note = Description of Unknown:uncultivated organism sequence
LKLLEMDKNGRVDKTASEYVMKTNRMGDVKLVVDKAHNENLYNCFVEKLQGGKYGKLSSFVTFGKNLQSGKEKFANLTTLEQAYVIVQILRFFKCDAQTADIRLIGGSGLSGKVLFNKDITTVDFQLIDQSPCGLTVRTRKL

SEQ ID NO: 10474 - protein, 142 aa, unidentified
  REGION 1..142: note = Description of Unknown:uncultivated organism sequence
LKLVEMAKQPTFNKNSDCYIVKTNRMGDIKLVVDKESNVKLYDELILKLECKRFQGFGAYTSFRNVLTESREKFVGLSTLEQAIVLLEVLKFFKNNADTADLSLIGESKCAGKLRFSKNITDVDFRIISQSPCGLTVHVKRV

SEQ ID NO: 10475 - protein, 142 aa, unidentified
  REGION 1..142: note = Description of Unknown:uncultivated organism sequence
VKILKLNDKNMIKKDESEYPTKVNSKEGKKLSVTAEMNIKFYRYLKDKMNDKIFAGISTFKKFSKALAKGEEAFISLSTLDQSKVLLQILKFLKCNGDTADTRLIGGSGRSGTICLNKDITDVDFKLIDFSPAGLTERIRRV

SEQ ID NO: 10476 - protein, 143 aa, unidentified
  REGION 1..143: note = Description of Unknown:uncultivated organism sequence
EKYQNMPATIKELLKTTDEEIIVSPAVKTNSKQLAISRTNNVYLYDLIIAQLGKKIYSLSSISGLVKKLTNARSVFLSLSISAQAELLLGLVKYVGGAYNVDLALLGESQYAGSTTIGKNISNLNISLIEQSVTGLYAKETVL

SEQ ID NO: 10477 - protein, 142 aa, unidentified
  REGION 1..142: note = Description of Unknown:uncultivated organism sequence
IKIIGMGDNGIITGNESQYITKTNKDGVIRIVVNKENNEKLYETLKNKLDSKIYKGLSAFASFKKNMERGKDKFCELSVLEQAKVLLQILKVFRCNAEISDIQAIGGTAHSGKKLFAKNITDVDFKLVNLSPAGLTVRIRKV

SEQ ID NO: 10478 - protein, 142 aa, unidentified
  REGION 1..142: note = Description of Unknown:uncultivated organism sequence
LNLEDMKSKKAVNVGDDKFVMKTDHTGAEKLVIDKATNIALYRDLMRRLGLKIYSGISAFATFAKNMKSGEDKFISLTVCDQATVLLQILKFFKCNAEISDITLIGGSGKSGTVLLNKNITDVDFEIINLSPAGLIERVRKV

SEQ ID NO: 10479 - protein, 134 aa, unidentified
  REGION 1..134: note = Description of Unknown:uncultivated organism sequence
VSFLKKLQEDNSYQYSPKFAGFSDSELNELLNILKWKITNTKFKNISEPVTKLLLKITQFDENLVLSIPDKAKLVMNLVGIFENRDHTNDLSLIGGKKQMGRLKKSIKPKGDFSIVYQSVTGFYVHEIKLNELK

SEQ ID NO: 10480 - protein, 143 aa, unidentified
  REGION 1..143: note = Description of Unknown:uncultivated organism sequence
EKYKNMPQVAKECLKEDGERLVVSPAVKENSRPQIITRTQNVALYDLIINQLSKKIYALSSIKAIVSNLKDKRDLFIALSIPNQAEVLLNLVKYVGGGYLVDLKLIGGTEQMGTTRISKDITNLNISLIEQSVTGLYSKGRKL

SEQ ID NO: 10481 - protein, 142 aa, unidentified
  REGION 1..142: note = Description of Unknown:uncultivated organism sequence
SKLVEMAKNETISEENGEYIIKTNRNKDVKLTINKHSNIELYDTLKNKLSKPSYQGLSPFSTFRKNLEGGEEKFANLSVADQCTVLLQILKFFKCNAETADIVLIGGSGRSGCILFNKDVSKADIKIICKSPAGLTERIKKV

SEQ ID NO: 10482 - protein, 142 aa, unidentified
  REGION 1..142: note = Description of Unknown:uncultivated organism sequence
LKLADMKAKGIINVGQEEFVMKTNRDGERKLVIDRANNANLYDMLKRKLERENYAGLSAFATFRKNLEKGEEKFNSLTVYEQTVVLLQILKFFKCNAETADTTLVGGSAKSGSIKFNNNITNVDFRLIDLSPAGLTERVRKV

SEQ ID NO: 10483 - protein, 142 aa, unidentified
  REGION 1..142: note = Description of Unknown:uncultivated organism sequence
LKLLEMDKNGRVDKTASEYVMKTNRMGDIKLVVDKAHNEKLYDCFVEKLQSGKYGNLSSFVTFGKNLQNGQEKFANLTTLEQAYVIVQILRFFKCDAQTADIRLIGGSGLSGKVLFNKDITTIDFQLVDQSPCGLTVRTRKL

SEQ ID NO: 10484 - protein, 142 aa, unidentified
  REGION 1..142: note = Description of Unknown:uncultivated organism sequence
SKLVEMAKNGTISEENGEYIIKTNRNKDVKLTINRQSNIELYETLKNKLSKPSYQGLSPFSTFRKNLESGEEKFANLSVADQCTVLLQILKFFKCNAETADIVLIGGSGRSGCILFNKDVSKADFKIICKSPAGLTERIKKV

SEQ ID NO: 10485 - protein, 146 aa, unidentified
  REGION 1..146: note = Description of Unknown:uncultivated organism sequence
ESFERKVKLNDKKVNFVYDEKKSGFSEQDLTNLFSELKSKVENTFFNCLPAVITNVLKNIDLQTYRVKEKDSDERLLTVEQKVHVVVELLKAFQSNGASSDLHDIGESKNSGIVRTTELDFEKYSIINYSVTGFYFIETKLRDLIK

SEQ ID NO: 10486 - protein, 142 aa, unidentified
  REGION 1..142: note = Description of Unknown:uncultivated organism sequence
LKIVEMAKQPTFNKNSDCYIVKTNRMGDIKLVVDKESNVKLYDELILKLECKRFQGFSAYTSFRNVLTESREKFVGLSTLEQAIVLLEVLKFFKNNADTADLSLIGESKRAGILRFSKNITDVDFRIISQSPCGLTVHVKRV

SEQ ID NO: 10487 - protein, 142 aa, unidentified
  REGION 1..142: note = Description of Unknown:uncultivated organism sequence
LKLADMKAKGIINVGQEEFVMKTNRDGERKLVIDRANNADLYGMLKRKLERENYAGLSAFATFRKNLEKGEEKFNSLTVYEQTVVLLQILKFFKCNAETADISSIGGGKIVGKIYVNINITNVDFRLIDLSPAGLTERVRKV

SEQ ID NO: 10488 - protein, 142 aa, unidentified
  REGION 1..142: note = Description of Unknown:uncultivated organism sequence
IKIIGMGDNGIITGNESQYITKTNKDGVIRIVVNKENNEKLYETLKNKLDSKIYKGLSAFASFKKNMERGKDKFCELSVLEQAKVLLQILKVFRCNAVNSNIELIGGGRGSGSIKINKNITDVDFKLVNLSPAGLTVRIRKV

SEQ ID NO: 10489 - protein, 142 aa, unidentified
  REGION 1..142: note = Description of Unknown:uncultivated organism sequence
LNLEDMKSKKAVNVGDDKFVMKTDHTGAEKLVIDKATNIALYRDLMRRLGLKIYSGISAFATFAKNMENGEDKFISLTVCDQATVLLQILKFFKCNAETSDITLIGGSGKSGTVLLNKNITDVDFEIINLSPAGLIERVRKV

SEQ ID NO: 10490 - protein, 142 aa, unidentified
  REGION 1..142: note = Description of Unknown:uncultivated organism sequence
IKIIGMGDNGIITGNESQYITKTNKDGVVRIVVNKENNEKLYETLKNKLDSKIYKGLSAFASFKTNMERGKDKFCELSVLEQAKVLLQILKVFRCNAEISDIQAIGGTAHSGKKLFAKNITDVDFKLVNLSPAGLTVRIRKV

SEQ ID NO: 10491 - protein, 142 aa, unidentified
  REGION 1..142: note = Description of Unknown:uncultivated organism sequence
SKLVEMSQNNMLPNNCEEYLVKTNRNKDKKLIVNKKTNIELYTKLKEKLSDSDKYAITTLSSFYQSIERGLDIFATLSTIDQCKVLLQILKGLKCNGGRADLSLINESKESGRILFSKNITNVDFKIICKSPAGLTERIKKV

SEQ ID NO: 10492 - protein, 151 aa, unidentified
  REGION 1..151: note = Description of Unknown:uncultivated organism sequence
VKLLEMAKNPTFDVNCEKYELTPNRERGEKIIIGRDSNVKLYDFLLKKFDSEDDAKNKINKRFQGISSYLAFGQNLKSGREKFVSLTVLQQVNVLSQVMKFFRCNADTADIELIGGSKGSGKILFNQNITDVDFRIISQSPCGLTVHVKRV

SEQ ID NO: 10493 - protein, 148 aa, unidentified
  REGION 1..148: note = Description of Unknown:uncultivated organism sequence
TKFNSLSNANVTMDISRDKIVVSPAKSKNGKELSLTKEENIQIYKKIADYVNTDMYSVITKGEISKILNEKIEVFSNLEMVEQSKFLYALVTTISNRGNLIWKLDAIGRSGQLTNYRINKNVTGKGYKLVKRNVLGYVIYQQDLENVR

SEQ ID NO: 10494 - protein, 142 aa, unidentified
  REGION 1..142: note = Description of Unknown:uncultivated organism sequence
IKIIGMGDNGIITGNESQYITKTNKDGVIRIVVNKENNEKLYETLKNKLDSKIYKGLSAFASFKTNMERGKDKFCKLSVLEQAKVLLQILKVFRCNAVNSNIELIGGGRGSGSIKINKNITDVDFKLVNLSPAGLTVRIRKV

SEQ ID NO: 10495 - protein, 148 aa, unidentified
  REGION 1..148: note = Description of Unknown:uncultivated organism sequence
SKFFSLSNANVTMDISRDKIVVSPAKNKNGKELSLTKEENIQIYKKIADYVNTDMYSVITKGEISKILNEKIEVFSNLEMVEQSKFLYGMVTTISNRGNLIWKLDAIGRSGQLTNYRINKNVTGKGYKLVKRNVLGYVIYQQDLENVR

SEQ ID NO: 10496 - protein, 143 aa, unidentified
  REGION 1..143: note = Description of Unknown:uncultivated organism sequence
EKHQNMPATIKELLKTTDEEIIVSPAVKTNSKQLAISRTNNLYLYDLIIAQLGKKIYSLSSISGLVEKLTTARSVFLSLSISAQAELLLGLVKYVGGAYTVDLTLLGEKKQAGSTRIGKNISNLNISLIEQSVTGLYAKEIVL

SEQ ID NO: 10497 - protein, 142 aa, unidentified
  REGION 1..142: note = Description of Unknown:uncultivated organism sequence
LKLVEMAKQPTFNKNSDCYIVKTNRMGDIKLVVDKGSNVKLYDELILKLECKQFQGFGAYTSFRNVLTESREKFVGLSTLEQAIVLLEVLKFFKNNADTADLSLIGESKCAGKLRFNKNITDVDFRIISQSPCGLTVHVKRV

SEQ ID NO: 10498 - protein, 142 aa, unidentified
  REGION 1..142: note = Description of Unknown:uncultivated organism sequence
LKIVEMQSKNMLDLYSDSLVIKTNSAGDEKLVVDKDKNLELYQRLTNKLNEKIYSGISAFSTFKNNLLNGEEKFAELELPEQAKVIIQILKFFKCNAETSDLTSIGGAKGSGSIKFNKNITDVDFRLINRSPAGLTEKVHRV

SEQ ID NO: 10499 - protein, 109 aa, unidentified
  REGION 1..109: note = Description of Unknown:uncultivated organism sequence
EKFVSRLKNKSIKIKYEKDKSGFTDEDLSSIYSELKDKSKNSVFKNLPKPIVKMLSDVDINNYKYQESEKSEPKLLTIEQKAVAICELIKAFHTESSNLLFLGEKKAQA

SEQ ID NO: 10500 - protein, 142 aa, unidentified
  REGION 1..142: note = Description of Unknown:uncultivated organism sequence
IKIIGMGDNGIITGNESQYITKTNKDGVIRIVVNKENNEKLYETLKNKLDSKIYKGLSAFASFKTNMERGKDKFCKLSVLEQAKVLLQILKVFRCNAEISDIQAIGGTAHSGKKLFAKNITDVDFKLVNLSPAGLTVRIRKV

SEQ ID NO: 10501 - protein, 142 aa, unidentified
  REGION 1..142: note = Description of Unknown:uncultivated organism sequence
LNLEDMKSKKAVNVGDDKFLMKTDHTGAEKLVIDKATNIALYRDLMRRLGLKIYSGISAFATFAKNMKSGEDKFISLTVCDQATVLLQILKFFKCNAETSDITLIGGSGKSGTVLLNKNITDVDFEIINLSPAGLIERVRKV

SEQ ID NO: 10502 - protein, 142 aa, unidentified
  REGION 1..142: note = Description of Unknown:uncultivated organism sequence
LKIVEMAKQPTFNKNSDCYIVKTNRMGDIKLVVDKESNVKLYDELILKLECKRFQGFGAYTSFRNVLTESREKFVDLSTLEQAIVLLEVLKFFKNNADTADLSLIGESKCAGILRFSKNITDVDFRIISQSPCGLTVQVKRV

SEQ ID NO: 10503 - protein, 142 aa, unidentified
  REGION 1..142: note = Description of Unknown:uncultivated organism sequence
SKLVEMAKNGTISEENGEYIIKTNRNKDVKLTINRQTNIELYDTLKNKLSKPSYQGLSPFSTFRKNLESGEEKFANLSVTDQCTVLLQILKFFKCNAELANISLIGGGKGSGRILFNKDITNADFKIICKSPAGLTERIKKV

SEQ ID NO: 10504 - protein, 145 aa, unidentified
  REGION 1..145: note = Description of Unknown:uncultivated organism sequence
GKLVEWERTGKIAEEEKARETFSMIKNRKEEVSLLIDRSQNVALYREIVAKLQTKLYRGLSAARSFAEKLSAKEEIFVSLSVLEQAKVLLQIARFMKCNAEAADLSLLKDGAACGILLIGKNITDVDFAVIHQSPCGINTYIQRV

SEQ ID NO: 10505 - protein, 142 aa, unidentified
  REGION 1..142: note = Description of Unknown:uncultivated organism sequence
LKLADMKTKGILNVGQEEFVMKTNRDGERKLVIDRANNADLYGMLKRKLERENYAGLSAFATFRKNLEKGEEKFNSLTVYEQTVVLLQILKFFKCNAETADTTLVGGSAKSGSIKFNNNITNVDFRLIDLSPAGLTERVRKV

SEQ ID NO: 10506 - protein, 142 aa, unidentified
  REGION 1..142: note = Description of Unknown:uncultivated organism sequence
GKLSDMEKNGRIDTKQEEYVIKTNRLKEVKLTVNRKDNIALYDYLLEKLNNKRYFGVGSFLSYYRTLLKAKEIFDTLSVLKQAATLLQILRFFKCNAETSDLSTIGGPAKSGKITVDKNITETDFSIIHRSACGLTERRQKV

SEQ ID NO: 10507 - protein, 141 aa, unidentified
  REGION 1..141: note = Description of Unknown:uncultivated organism sequence
SKTVKLMNDKKELNIEDGNIVVAQNRFGEKSLLTKEENMKLYKELIKHLNKSIYKCISLGKIGKDLKNTYEIFENIDIVEQVKTIKGLLDIINGVSGGDITNVGGSKNSGLISFSKTLSKNPVSIINSSPTGFYQKEFKLV

SEQ ID NO: 10508 - protein, 142 aa, unidentified
  REGION 1..142: note = Description of Unknown:uncultivated organism sequence
VKLLEMAKNPTFDVNCEKYEFTPNRERGEKITIDRESNIKLYDFFLSKFDCSKFKGVSSYVTFGKNLSIGREKFVALTVSQQVNVLNQIVNFFKCNAETADIELIGGSKISGKILFNKNITDVDFRIISQSPCGLTVHVKRV

SEQ ID NO: 10509 - protein, 142 aa, unidentified
  REGION 1..142: note = Description of Unknown:uncultivated organism sequence
IKIIGMSDNGIITGNESQYITKTNKDGVIRIVVNKENNEKLYETLKNKLDSKIYKGLSAFASFKTNMERGKDKFCELSVLEQAKVLLQILKVFRCNAEISDIQAIGGTAHSGKKLFAKNITDVDFKLVNLSPAGLTVRIRKV

SEQ ID NO: 10510 - protein, 142 aa, unidentified
  REGION 1..142: note = Description of Unknown:uncultivated organism sequence
GKLSDMEKNGRIDTQQEEYVIKTNRLKEVKLTVNRKDNIALYDYLLEKLNDKRYFGVGSFLSYYRTLLKAKEIFDTLSVLKQAATLLQILRFFKCNAETSDLSTIGGSNRSGTIRINKDITETEFSIIHRSACGLTERRQKV

SEQ ID NO: 10511 - protein, 151 aa, unidentified
  REGION 1..151: note = Description of Unknown:uncultivated organism sequence
VKLLEMAKNPTFDVSCEKYELTPNRERGEKIIIDRDSNVKLYDFLLKKFDSEGDAKNKINKRFQGISSYLAFGQNLKSGREKFVSLTVLQQVNVLSQVMKFFRCNADTADIELIGGSKGSGKILFNQNITDVDFRIISQSPCGLTVHVKRV

SEQ ID NO: 10512 - protein, 142 aa, unidentified
  REGION 1..142: note = Description of Unknown:uncultivated organism sequence
LKITDMKAKNMIMSEDESYAVKTNRSGNDKLVVNRDKNVALYRDFKNRLSKPAYKGISAFETFKNNLEKSEDKFISLTVTEQARVLLQILKLFKCNAETVDLSLLGGAGRSGTLLVNKNITNVDFKLINYSPAGLTKKVRTV

SEQ ID NO: 10513 - protein, 142 aa, unidentified
  REGION 1..142: note = Description of Unknown:uncultivated organism sequence
LNLEDMKSKKAVNVGDDKFVMKTDHTGAEKLDIDKATNIALYRDLMRRLGLKIYSGISAFATFAKNMKSGEDKFISLTVCDQATVLLQILKFFKCNAEISDITLIGGSGKSGTVLLNKNITDVDFEIINLSPAGLIERVRKV

SEQ ID NO: 10514 - protein, 142 aa, unidentified
  REGION 1..142: note = Description of Unknown:uncultivated organism sequence
SKLVEMSQNNMLPNNCEEYLVKTNRNKDKKLIVNKKTNMELYIKLKEKLSDSDKYAITTLSSFYQSIERGSDIFATLSTIDQCKVLLQILKGLKCNGGRADLSLINESKESGRILFSKNITNADFKIICKSPAGLTERIKKV

SEQ ID NO: 10515 - protein, 143 aa, unidentified
  REGION 1..143: note = Description of Unknown:uncultivated organism sequence
EKHQNMPATIKELLKTTDEEIIVSPAVKTNSKQLAINRTNNLYLYDLIIAQLGKKIYSLSSISGLVEKLTTARSVFLSLSISAQAELLLGLVKYVGGAYTVDLTLLGEKKQAGSTRIGKNISNLNISLIEQSVTGLYAKEIVL

SEQ ID NO: 10516 - protein, 142 aa, unidentified
  REGION 1..142: note = Description of Unknown:uncultivated organism sequence
VKLLEMAKNPTFDVNCEKYEFTPNRERGEKITIDRNSNIKLYDFLLLKFENKKFRGISSYLSFERNLYSGREKFIELTVLQQVWILSQIKQFFKCNDKSADIELIGGSKGSGKIVFGKNITDVDFRIISQSPCGLTVHVKRV

SEQ ID NO: 10517 - protein, 142 aa, unidentified
  REGION 1..142: note = Description of Unknown:uncultivated organism sequence
LKLADMKARGVINVGQEEFVMKTNRDGERKLVIDRANNADLYGMLKRKLERENYAGLSAFATFRKNLEKGEEKFNSLTVYEQTVVLLQILKFFKCNAETADISSIGGGKIVGKIYVNINITNVDFRLIDLSPAGLTERVRKV

SEQ ID NO: 10518 - protein, 142 aa, unidentified
  REGION 1..142: note = Description of Unknown:uncultivated organism sequence
LKLLDMDAKKMLLGDEPRYVIKTNRNKEEKLVIDKEKNVELYGYLKNKLCDKIYSGLSAFATFAKNIENGKEKFIDLTIVEQAKVLIQILMMFKRKDTLSDLTLIGGSSLSGKIRIGKKIDGVNFEIIHLSPAGLRVIKNKV

SEQ ID NO: 10519 - protein, 126 aa, unidentified
  REGION 1..126: note = Description of Unknown:uncultivated organism sequence
DEKSVEFEFAKGKIISKSDIKLVFEAIVNQLKKPFYGKYAFVKKFNEGKLNIDKFYEANLLDQMKFILSMLNLITLNGSLFNAELIDGAANETCKYLTNLKGCSVYLISQSVTGLYEKRIKIIDPQ

SEQ ID NO: 10520 - protein, 146 aa, unidentified
  REGION 1..146: note = Description of Unknown:uncultivated organism sequence
IKLADTLREGRIGDGEKNKEQFIMHTNRFGKNKTVVDKEHNEQLYEVITEKLSNKAYVGLSAAKTFLNNVSAGKENFKNLSALDQALALIQIMKFLKCNAETSNLEKIGASARAGSILINKNISNVSFKIIHTSPCGLTVRKIAIK

SEQ ID NO: 10521 - protein, 146 aa, unidentified
  REGION 1..146: note = Description of Unknown:uncultivated organism sequence
ESFERKVKLNDKKVNFVYDEKKSGFSEQDLTNLFSELKSKVENTFFNCLPVVITNVLKNIDLQTYRVKEKDSDERLLTIEQKVHVVVELLKAFQSNGASSDLHDIGESKNSGIVRTTELDFEKYSIINYSVTGFYFIETKLRDFIK

SEQ ID NO: 10522 - protein, 133 aa, unidentified
  REGION 1..133: note = Description of Unknown:uncultivated organism sequence
VKNVSRLQPVKKEDEKKNIVIENITLSDTEVLFEAIVEQLKKKFYENYTFAKKIKDGNVSFDKFKSLELFKRIEVLNEMLKNINHSSSICHADAVGGAANDNCKWNKANPKRKVSLVTYSPSGLFENVIPLIN

SEQ ID NO: 10523 - protein, 135 aa, unidentified
  REGION 1..135: note = Description of Unknown:uncultivated organism sequence
AKNISRLQSAKKDNKKIKIDIENITFSDTEYLFNAIVEQLRKKFYSNYTFAKKIMAGDVTLERFKKLDLVRRIEILNEIMKNINHSSSVCKSNEIGGAKNGDNCRWNQANPKGRKVSLVTYSPSGLFEKVIPLIN

SEQ ID NO: 10524 - protein, 126 aa, unidentified
  REGION 1..126: note = Description of Unknown:uncultivated organism sequence
DDNSVEFEFAKGKIISKSDIKLVFEAIVNQLKKPFYGKYAFVKKFNEGKLNIDKFYEANLLDQMKFILSMLNLITLNGSLFNAELIDGAANETCKYLTNLKGCSVYLISQSVTGLYEKRIKIIDPQ

SEQ ID NO: 10525 - protein, 142 aa, unidentified
  REGION 1..142: note = Description of Unknown:uncultivated organism sequence
KKLLDMNKEVKQKPESEEFIMKTNNEGVRKLVITRQSNIEKYDMLAAQLGKDFYQVLSPFRNVKKIIDEGKEKFCELLVIDQCYVLMQILSYLQCKGATADLQLIGGSGRSGQIRFNKDITNVDFRIYDTSPTGLFVKESKA

SEQ ID NO: 10526 - protein, 142 aa, unidentified
  REGION 1..142: note = Description of Unknown:uncultivated organism sequence
LKIVEMAKQPTFNKNSDCYIVKTNRMGDIKLVVDKESNVKLYDELILKLECKQFQGFGAYTSFRNVLTESREKFVDLSTLEQAIVLLEVLKFFKNNADTADLSLIGESKRAGILRFSKNITDVDFRIISQSPCGLTVHVKRV

SEQ ID NO: 10527 - protein, 142 aa, unidentified
  REGION 1..142: note = Description of Unknown:uncultivated organism sequence
LKLADMKTKGIINVGQEEFVMKTNRDGERKLVIDRANNADLYDMLKRKLERENYAGLSAFATFRKNLEKGEEKFNSLTVYEQTVVLLQILKFFKCNAETADTTLVGGSAKSGSIKFNNNITNVDFRLIDLSPAGLTERVRKV

SEQ ID NO: 10528 - protein, 142 aa, unidentified
  REGION 1..142: note = Description of Unknown:uncultivated organism sequence
LKLADMKAKGIINVGQEEFVMKTNRDGERKLVIDRANNADLYGMLKRKLERENYAGLSAFATFRKNLEKGEEKFNSLTVYEQTVVLLQILKFFKCNAETADTTLVGGSAKSGSIKFNNNITNVDFRLIDLSPAGLTERVRKV

SEQ ID NO: 10529 - protein, 142 aa, unidentified
  REGION 1..142: note = Description of Unknown:uncultivated organism sequence
GKLSDMEKNGRIDTQQEEYVIKTNRLKEVKLTVNRKDNIALYDYLLEKLNDKRYFGVGSFLSYYRTLLKAKEIFDTLSVLKQAATLLQILRFFKCNAETSDLSTIGGPAKSGKIRINKDITETEFSIIHRSACGLTERRQKV

SEQ ID NO: 10530 - protein, 142 aa, unidentified
  REGION 1..142: note = Description of Unknown:uncultivated organism sequence
IKIIGMGDNGMITGNESQYITKTNKDGVIRIVVNKENNEKLYETLKNKLDSKIYKGLSAFASFKTNMERGKDKFCELSVLEQAKVLLQILKVFRCNAKKSNIELIGGGCDSGSIKINKNITDVDFKLVNLSPAGLTVRIRKV

SEQ ID NO: 10531 - protein, 142 aa, unidentified
  REGION 1..142: note = Description of Unknown:uncultivated organism sequence
IKIIGMGDNGIITGNESQYITKTNKDGVVRSVVNKENNEKLYETLKNKLDSKIYKGLSAFASFKTNMERGKDKFCELSVLEQAKVLLQILKVFRCNAVNSNIELIGGGRGSGSIKINKNITDVDFKLVNLSPAGLTVRIRKV

SEQ ID NO: 10532 - protein, 142 aa, unidentified
  REGION 1..142: note = Description of Unknown:uncultivated organism sequence
LKIVEMAKQPTFNKNSDCYIVKTNRMGDIKLVVDKESNVKLYDELILKLECKQFQGFGAYTSFRNVLKESREKFVDLSTLEQAIVLLEVLKFFKNNADTADLSLIGESKRAGILRFSKNITDVDFRIISQSPCGLTVHVKRV

SEQ ID NO: 10533 - protein, 143 aa, unidentified
  REGION 1..143: note = Description of Unknown:uncultivated organism sequence
EKYQNMPAAIKELLKTTDEEIIVSPAVKTNSKQLAISRTNNVYLYDLIVAQLGKKIYNLSSISGLVKKLTNARSMFLSLSISAQAELLLGLVKYVGGAYNVDLSLLGESQHAGSTTIGKNISNLNISLIEQSVTGLYAKETVL

SEQ ID NO: 10534 - protein, 145 aa, unidentified
  REGION 1..145: note = Description of Unknown:uncultivated organism sequence
GKLVEWERTGKIAEEEKARETFSMIKNRKEEVSLLIDRSQNVALYREIVAKLQTKLYQGLSAVRSFAEKLSAKEEIFVSLSVLEQAKVLLQIARFMKCNAEAADLSLLKDGSRCGILLIGKNITDVDFAVIHQSPCGINTYIQRV

SEQ ID NO: 10535 - protein, 142 aa, unidentified
  REGION 1..142: note = Description of Unknown:uncultivated organism sequence
LKIVEMAKQPTFNKNSDCYIVKTNRMGDIKLVVDKGSNVKLYDELILKLECKQFQGFGAYTSFRNVLTESREKFVDLSTLEQAIVLLEVLKFFKNNADTADLSLIGESKRAGILRFSKNITDVDFRIISQSPCGLTVHVKRV

SEQ ID NO: 10536 - protein, 142 aa, unidentified
  REGION 1..142: note = Description of Unknown:uncultivated organism sequence
GKLSDMEKNGRIDTQQEEYVIKTNRLKEVKLTVNRKDNIALYDYLLEKLNNKRYFGVGSFLSYYRTLLKAKEIFDTLSVLKQAATLLQILRFFKCNAETSDLSTIGGPNRSGTIRINKDITETEFSIIHRSACGLTERRQKV

SEQ ID NO: 10537 - protein, 142 aa, unidentified
  REGION 1..142: note = Description of Unknown:uncultivated organism sequence
SKLVEMAKNGTISEENGEYIIKTNRNKDVKLTINRQSNIELYDTLKNKLSKPSYQGLSPFSTFRKNLESGEEKFANLSVADQCTVLLQILKFFKCNADTADISLIGGGETCGRIRFNKDISKVNFEIVCKSPAGLTERIKKV

SEQ ID NO: 10538 - protein, 142 aa, unidentified
  REGION 1..142: note = Description of Unknown:uncultivated organism sequence
SKLVEMAKNGTISEENGEYIIKTNRNKDVKLTINRQSNIELYDTLKDRLSKPIYQGLSPFSTFRKNLESGEEKFANLSVTDQCTVLLQILKFFKCNAETADIVLIGGSSGSGSIKFNKDISDIDFEIICKSPAGLTERIKKV

SEQ ID NO: 10539 - protein, 145 aa, unidentified
  REGION 1..145: note = Description of Unknown:uncultivated organism sequence
AKLLERERAGEYSAEEKAQEVFPMHVNRLGEVKQTVDRAQNQALYDLMLRQLGKPVYGGISGAVSFRNTLNSRREQFAALPVLKQAKVLIQIAKFLKCNAESADLTELGEGANCGLLRVGKNITDVDFRIVDQSPCGLSIRERKV

SEQ ID NO: 10540 - protein, 143 aa, unidentified
  REGION 1..143: note = Description of Unknown:uncultivated organism sequence
GKLLDSEKTRKSEDLSDEVFVMHTNRFGEVKLKIDREQNLELYQKILKQLSKKIYGGISGAVHFRAVLQNAENKFASLTVFGQSKVLIQILKFLKCNAETSDLTLLGEGGRCGTLTINKNITDLEFSVVHVSPCGLDEKERKI

SEQ ID NO: 10541 - protein, 143 aa, unidentified
  REGION 1..143: note = Description of Unknown:uncultivated organism sequence
GKLLEREKKGEIVNAGDEVFVMHTNRLGEIRFKIDREQNEDLYEAILHQLSKKVYGGISGAVYFSSTLQNKADKFKSLTVLEQAKTLMQIVKFLKCNAEAANLNLLDEGSACGKLGINKNITGVDFEVVHSSPCGLDEKVRKV

SEQ ID NO: 10542 - protein, 158 aa, unidentified
  REGION 1..158: note = Description of Unknown:uncultivated organism sequence
FKFKKLIDDKNFSKETVEEWKETPHDIEFATRERNKNIKEGKKISRENNLKLYDAIIEQIKKPFYQNYPTGKKVREEKILREKFEILKTFSQMEQLVELLNVITMNKANADTTNIGGVKYDECKYKISGCNNVTSKNIILITQSPTGLFENKIAINLK

SEQ ID NO: 10543 - protein, 151 aa, unidentified
  REGION 1..151: note = Description of Unknown:uncultivated organism sequence
NRYLREIELREKEDTELLTSNEPYTIIIGNRNEKEKVQKIVISKESNEKTYLELAMHFAKDIYEHIFRGVNDTLLSNLDNFKTKSIYEQANIIKQLVMLLQTGALPASINLTSVGLNKSINRNRNINLIEKGDKLLIQSITGLYDKEICLA

SEQ ID NO: 10544 - protein, 154 aa, unidentified
  REGION 1..154: note = Description of Unknown:uncultivated organism sequence
YKYFEQLEIRSNRKKMNENEMQSLKEIQVIFSSNEKRRQNENRLRFITLEKNKIVFENLIKQIAKPIYEKSFGKRRDIIISNKDQFYKLGLERQIEVISNLHRFIKSGVPGRIDLEELGVKSGNLTMNYKIEDLSIIKQSITGLYQKEIIIKQV

SEQ ID NO: 10545 - protein, 184 aa, unidentified
  REGION 1..184: note = Description of Unknown:uncultivated organism sequence
SIMHEKAVKTAAHIPQDELKGKTAEKKSEPKINTQDLAFRALEEEKRRRKEVNEKTKIIFITKENNLKVYEFLAKKAASHPFIGVPRYDPFRDALALGKQSFVDMDEYRQLRVILKILPAFQCNALKVDMSDLNWVEEKNGIMKTVSGKKTTCNIRINKKITDKRITLIYQNKTGLKEQRFLLT

SEQ ID NO: 10546 - protein, 184 aa, unidentified
  REGION 1..184: note = Description of Unknown:uncultivated organism sequence
SIMHEKAVKTAAHIPQDELKGKTAEKKSEPKINTQDLAFRALEEEKRRRKEVNEKTKIIFITKENNLKVYEFLAKKAASHPFIGVPRYDPFRDALALGKQSFVDMDEYRQLRVILKILPAFQCNALKVDMSDLNWVEEKNGIMKTVSGKKTTCNIRINKKITDKRITLIYQNKTGLKEHRFLLT

SEQ ID NO: 10547 - protein, 142 aa, unidentified
  REGION 1..142: note = Description of Unknown:uncultivated organism sequence
VKLLEMAKNPTFDVNCEKYELTPNRERGEKITIDRESNIKLYDFFLSKFDCSKFKGFSSYVTFGKNLSIGREKFVALTVSQQVNVLNQIVNFFKCNAETADIELIGGSKISGKILFNKNITDVDFRIISQSPCGLTVHVKRV

SEQ ID NO: 10548 - protein, 142 aa, unidentified
  REGION 1..142: note = Description of Unknown:uncultivated organism sequence
LKITDMKAKNMIVSEDESYAVKTNRSGNDKLVVNRDKNVELYRDFKNRLSKPAYKGISTFGTFQSKLEKSEGKFISLTVIDQARVLLQILKFFKCNAEVADLTLLGDGKRCGTLRINKNITNVEVKLINYSPAGLTKKVRTV

SEQ ID NO: 10549 - protein, 142 aa, unidentified
  REGION 1..142: note = Description of Unknown:uncultivated organism sequence
VKLLGMKGNKSVDENASEYPTKTNRLGEVKCVINRENNEKLYRMLKEKLSEKMYSGLSSAKTFGRNLETSEEKFVSLSVMEQAEVLLQILKFFKCNAEKSNLKSVEGSPNAGTILFNKDITDVNFKLIDLSPAGLTERVRKV

SEQ ID NO: 10550 - protein, 143 aa, unidentified
  REGION 1..143: note = Description of Unknown:uncultivated organism sequence
EKHQNMPATIKELLKTTDEEIIVSPAVKTNSKQLAISRTNNLYLYDLIIAQLGKKIYSLSSISGLVEKLTNARSVFLSLSISAQVELLLGLVKYVGGAYTVDLTLLGEKKQAGSTRIGKNISNLNISLIEQSVTGLYAKEIVL

SEQ ID NO: 10551 - protein, 145 aa, unidentified
  REGION 1..145: note = Description of Unknown:uncultivated organism sequence
GKLVEWERTGKIAEEERMKEIFPMVKNRKEEVSVLIDRTQNVALYREIVTKLHSKLYQGLSAARSFAEKLSAKEESFLSLSVLEQAKVLLQIVRFMKCNAEAADLSLLKDGSRCGILSIGKNITDVDFKVIHQSPCGLSTYIQRT

SEQ ID NO: 10552 - protein, 163 aa, unidentified
  REGION 1..163: note = Description of Unknown:uncultivated organism sequence
YKYFEQKSLKGKKKKKDETSEVIISEDQENQEEVQQIKEIQVIFSKDEERLRFINFKKNKKVFEKLIEKIKKPIYKKSHTERRIKIINNKNEFYKLSLERQTEIIISLHKLLKTGVPGRNDIDLAEFGVKTGELTASYKIEDMSIVKQSITGLYQKEIIIKQV

SEQ ID NO: 10553 - protein, 163 aa, unidentified
  REGION 1..163: note = Description of Unknown:uncultivated organism sequence
YKYFEQKSLKGKKKKKDETSEVINSEDQENQEEVQQIKEIQVIFSKDEERLRFINFKKNKKVFEKLIEKIKKPIYEKSHTVRRIKIINNKNEFYKLSLERQTEIIISLHKLLKTGVPGRNDIDLAEFGVKTGGLTASYKIEDMSIVKQSITGLYQKEIIIKQV

SEQ ID NO: 10554 - protein, 156 aa, unidentified
  REGION 1..156: note = Description of Unknown:uncultivated organism sequence
NKYFERKAAAKVTNEDEQLSRENIEKIQVIFSFNEKEKTRKNDRLRYITRDKNEKAFECLIKQIEKPIYEKSFGSRREKILENMEKFYDLKLVRQVEIIRALHEFLKTGVPAIKIKLEELGVKSGTLTMSYKLEDMTIVKQSITGLYQKEIHIKEV

SEQ ID NO: 10555 - protein, 156 aa, unidentified
  REGION 1..156: note = Description of Unknown:uncultivated organism sequence
NKYIERKKETKKTNKDEQLTEENIEKIQVIFTFNGEGRTRKNDRLRYITRDKNKRAFECLIKQIEKPLYEKSHSDRRKKILENKEKFYDLKLVRQVEIVRALHELLKSGVPPSKINLEELGVKSGKLTMSYKLKDMVIVKQSITGLYQKEIHIEEV

SEQ ID NO: 10556 - protein, 140 aa, unidentified
  REGION 1..140: note = Description of Unknown:uncultivated organism sequence
ESFSKKKKQNNFLFVDEVYDKITKEENRELFLFLTNKVEEEPYCLIFGSQLQVLHDKENEFENLNLEQQVETLLNLLSIFKTGRTTGCDLKLLGGAGQAGIFTESSKLSNWKKSYKDVRIVDISAAGLHRKTSQNLLELL

SEQ ID NO: 10557 - protein, 140 aa, unidentified
  REGION 1..140: note = Description of Unknown:uncultivated organism sequence
ESFSKKKKQNNSLFVDEVYDKITKEENRELFLFLTNKIEEAPYCLIFGSQLQVLHDKENEFENLNLEQQVETLLNILSIFKTGRTTGCDLKSLGGVGQAGIFTESSKLSNWKKSYEDVRIVDISAAGLHRKISQNLLELL

SEQ ID NO: 10558 - protein, 140 aa, unidentified
  REGION 1..140: note = Description of Unknown:uncultivated organism sequence
ESFAKKKKQNNSLLVDEVYDKITKEENRELFLFLTNKVKEMPYCLIFGSQLQVLHDKENEFENLKLEQQVETLLNVLFIFKTGRTTGCDLKALGGAGQAGIFTESSKLSNWKKSYKDVRIVDISAAGLHRKISQNLLELL

SEQ ID NO: 10559 - protein, 140 aa, unidentified
  REGION 1..140: note = Description of Unknown:uncultivated organism sequence
ESFSKKKKQNNSLLVDEVYDKITKEENRELFLFLTNKVEEEPYCLIFGSQLQVLHDKENEFENLNLEQQVETLLNLLSIFKTGRTTGCDLKLLGGAGQAGIFTESSKLSNWKKSYKDVRIVDISAAGLHRKTSQNLLELL

SEQ ID NO: 10560 - protein, 140 aa, unidentified
  REGION 1..140: note = Description of Unknown:uncultivated organism sequence
ESFYKKKKQNNSLLVDEVYDKITKEENRELFLFLTNKVKEMPYCLIFGSQLQVLHDKENEFKNLKLEQQVETLLNVLSIFKTGRTTGCDLKALGGARQAGIFTESSKLSNWKKSYKDVRIVDISAAGLHRKISQNLLELL

SEQ ID NO: 10561 - protein, 140 aa, unidentified
  REGION 1..140: note = Description of Unknown:uncultivated organism sequence
ESFSKKKKQNNFLFVDEVYDKITKEKNRELFLFLTNKVEEEPYCLIFGSQLQVLHDKENEFENLNLEQQVETLLNLLSIFRTGRTTGCDLKLLGGAGQAGIFTESSKLSNWKKSYKDVRIVDISAAGLHRKISQNLLELL

SEQ ID NO: 10562 - protein, 140 aa, unidentified
  REGION 1..140: note = Description of Unknown:uncultivated organism sequence
ESFSKKKKQNNFLFVDEVYDKITKEENRELFLFLTNKVEEEPYCLIFGSQLQVLHDKENEFENLNLEQQVETLLNLLSIFKTGRTTGCDLKLLGGAGQAGIFTESSKLSNWKKSYKDVRIVDISAAGLHRKISQNLLELL

SEQ ID NO: 10563 - protein, 140 aa, unidentified
  REGION 1..140: note = Description of Unknown:uncultivated organism sequence
ESFSKKKKQNNFLFVDEVYDKITKEENRELFLFLTNKVEEEPYCLIFGSQLQVLHDKENEFENLNLEQQVETLLNLLSIFKTGRTTGCDLKLLGGAGQAGIFTESSKLSNWKKSYKDVRIVDISVAGLHRKTSQNLLELL

SEQ ID NO: 10564 - protein, 134 aa, unidentified
  REGION 1..134: note = Description of Unknown:uncultivated organism sequence
EKYLQRDQQNARERLSITERDEITSERNLWLYDELYRKQSETIYRYRPNSQCRILADGRERFLELSCEEQCAVLNEILHLLQCKSIMANLKMVGGSGLAGKILVNKVITKCNEAKLIHQSVTGLFEQEIDLLAL

SEQ ID NO: 10565 - protein, 133 aa, unidentified
  REGION 1..133: note = Description of Unknown:uncultivated organism sequence
EKVNNRKKRFPNTFKLYPEEDKISKEENLLLYDELTRKLGIKPFSNRPGGFFEKLQNGRSLFIELNCEEQVFELIEILQLFGTNSTLSNLSAIGCAKTAGGINISPNLDISKNKYVIINQSVTGLFEKTERLG

SEQ ID NO: 10566 - protein, 131 aa, unidentified
  REGION 1..131: note = Description of Unknown:uncultivated organism sequence
VKHAKKTKDKNVIGYEDLDGISKSSNEKIYELLLKKAKLPIYKSRPANAIKVLESGYERFKNLTLEDQISALTSILDYFGMRNGIADLQLVGGKANSGKIRIQATVNPSKKRVFIIDQSITGIYDSWFELK

SEQ ID NO: 10567 - protein, 132 aa, unidentified
  REGION 1..132: note = Description of Unknown:uncultivated organism sequence
EKFTNAKRLDKNLLIDEKYDEISREENIELYELLLKKCKLYIMRNRPGNSTGIIERGEEVFTNLPIEQQTQTLMNILNYLSMGNGCTDFSLIGGGKANGTLTLSSTIDPSKKKVCIFDQSITGIYEERLKLE

SEQ ID NO: 10568 - protein, 133 aa, unidentified
  REGION 1..133: note = Description of Unknown:uncultivated organism sequence
VKFHDRQRIMKNTLTVSDFDDITKDKNLELYDVLLSKLKDSVYCTVYLAPLKLLTEKREKFISLSVELQAELLYNALHLFQCNRVNSDLSLLGGSPNSGIILIQKTVTDKNKECLINQSPTGLFENKIDLKTI

SEQ ID NO: 10569 - protein, 130 aa, unidentified
  REGION 1..130: note = Description of Unknown:uncultivated organism sequence
SKHMLELQKDKRALLPDNQLLKESDMDELYLELCRKLKDSIYQVMLGRFLDTYESGYRRYQELSIEKKAEALYQMLKLFQCTPEMPNLTLIGGNAKPGPIRIGMNVTDRSSLAIVHQSVTGIYEQIERII

SEQ ID NO: 10570 - protein, 130 aa, unidentified
  REGION 1..130: note = Description of Unknown:uncultivated organism sequence
SKHMLELQKDKRALLPDNQLLKEEDMDKLYLELCRKLQESIYRVMLGRFSDTYESGYKRYQELSREKKAEALYQMLKLFQCTPELPNLTLIGGTGTQGAIRIGMNVTDRKSLAIIHQSVTGIYEQIERIV

SEQ ID NO: 10571 - protein, 131 aa, unidentified
  REGION 1..131: note = Description of Unknown:uncultivated organism sequence
SKHIQELQYDMDAAISDNGLLTEQDLDALYIELCEKLKGSVYQTMLGGYIEKYESGYEKYQKLTLEKKAQALWQMLKIFQCTPEMPDLTLIGGSKSQGAIRMGMNVTGRKSLALIHQSVTGIYERVEKIRG

SEQ ID NO: 10572 - protein, 130 aa, unidentified
  REGION 1..130: note = Description of Unknown:uncultivated organism sequence
SKHMLELQKDKRALLPDNQLLKESDMDELYLELCRKLKDSIYQVMLGRFLDTYESGYRRYQELSIEKKAEALYQMLKLFQCTPEMPNLTLIGGNAKPGSIRIGMNVTDRSSLAIVHQSVTGIYEQIERII

SEQ ID NO: 10573 - protein, 131 aa, unidentified
  REGION 1..131: note = Description of Unknown:uncultivated organism sequence
GKHMKELSYDKNARISDNGLLTQDDLDELYRVLCEKLENTVYKIMLHGYIEKYRSGFELYEKLSLEKRAEALWQMLKIFQCTPEMPDLTLIGGSKNQGAIRMGMDISGRESLAIIHQSVTGIYEQIEKIRG

SEQ ID NO: 10574 - protein, 138 aa, unidentified
  REGION 1..138: note = Description of Unknown:uncultivated organism sequence
EKYLSLLKKVKDPEVQENAEILAESLHICKQDNLTLYELLLAKERGSIYRYRPANQAKFLEEKRSIFESLDIKGQCEVLVQIINLFTCTPESANLTKLGGGSSSGIVKFQSQITDKEARLIHQSPTGIFTKSRRVYEI

SEQ ID NO: 10575 - protein, 135 aa, unidentified
  REGION 1..135: note = Description of Unknown:uncultivated organism sequence
LKFNNRKAVQKDAVVTAYDGITDENTLELYDFFADKLSHSIYRKKLSAQADFLDQSKDKFAGLPLEERCEVLGAILHLFQCNAVLSDFHLLGGSRQAGRIYLNKKIKAQDHVCLIVQSVTGFFEKRILLAPYGEK

SEQ ID NO: 10576 - protein, 62 aa, unidentified
  REGION 1..62: note = Description of Unknown:uncultivated organism sequence
VRFCEREKESKKAFTVSGFDGIEKDRNIELFDFFYQKTFKRYFYGPSCGNIEISVGEQEHIC

SEQ ID NO: 10577 - protein, 125 aa, unidentified
  REGION 1..125: note = Description of Unknown:uncultivated organism sequence
LKYNLSEQGEISDEEVSYLYDFFIDKLQNTIYSKKFDGIAKKLSSKRSKFSNLKLKDKCKVLKEVLQLFQCNSSPANLTVLGCADRTGLLTIGKNISEKDHVYLIEQSITGFYEKRILLNPYEGK

SEQ ID NO: 10578 - protein, 138 aa, unidentified
  REGION 1..138: note = Description of Unknown:uncultivated organism sequence
EKYLSLLKKVKDTEVEKNAEILAESLHITRQDNLQLYEQLLAKERDSIYKYRPANQAKFLEEKKSTFESLDIKAQCEVLVQIINLFTCTPESANLEKLEGGSSSGIVKFHSQITDREAKLIHQSPTGIFTKTRRIYEL

SEQ ID NO: 10579 - protein, 138 aa, unidentified
  REGION 1..138: note = Description of Unknown:uncultivated organism sequence
EKYLSLLKKVKAPEIKENAEILAESLHICKQDNLTLYELLLAKERDSIYRYRPANQAKFLEEKRSVFESLDIKGQCAVLVQIINLFTCTPESANLTKLGGGSSSGIVKFQSQIADKEARLIHQSPTGIFTKSRRVYEI

SEQ ID NO: 10580 - protein, 135 aa, unidentified
  REGION 1..135: note = Description of Unknown:uncultivated organism sequence
LKFIHRKTVQKDAVITEYDGVSDDNTLALYDLFVKKLSSSIYRKKYATQADFLCQSKDKFKNLPLEERCEVLGSILHLFQCNPVLSDLHLLGGKKSTGTILLNKKIKPEDHVYLIEQSVTGFFEKRILLAPLGEK

SEQ ID NO: 10581 - protein, 104 aa, unidentified
  REGION 1..104: note = Description of Unknown:uncultivated organism sequence
LKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGK

SEQ ID NO: 10582 - protein, 135 aa, unidentified
  REGION 1..135: note = Description of Unknown:uncultivated organism sequence
LKFIQRKKVQKNAAITEYDGISDDNTLALYDCFVDKLSSSIYGKEFAMQADFLRQSKNKFTNLSLEERCEVLGSILHLFQCNPVLSDLRLLGGKKSTGTIRLNKKIKPEDHVYLIEQSITGFFEKRILLAPFGEK

SEQ ID NO: 10583 - protein, 138 aa, unidentified
  REGION 1..138: note = Description of Unknown:uncultivated organism sequence
LKFNQRAAMSKKGEEIFINSFDNIQEEDLNRLYHVFEDKLTNQIYKVKLEKQAAVLKKGEETFNRLSPEQKCKLIGEILHLCQCKATHADLRLIGGAKKAGILTMGTQIYPKDHVYLIEQSVTGFFEKRILLAPFGEK

SEQ ID NO: 10584 - protein, 133 aa, unidentified
  REGION 1..133: note = Description of Unknown:uncultivated organism sequence
ESFNRKKTQFRGIAISSEHDGITEENITNLYEALMKKSNSKIFSIRPASQAKLITEKYGTFKKLSLQDKCSVVTSLLDYFGMTGGVSDLKLLGGKSSVGAIKKPGKYNTTNSSIKIVDQSITGLFEEIEEIKA

SEQ ID NO: 10585 - protein, 159 aa, unidentified
  REGION 1..159: note = Description of Unknown:uncultivated organism sequence
EVFMKHYPKFVENELNESEIDYYKFDSNKNLKLYDFFLERLLDNPFCKYARTKNSKSDYEQLNEKRTDFINLSMYKQVVVLFRLFKIFRCNAECAKFEDNFDTNFKIEGNLGEMFGNKKIDIITGKGNGKKSIYILNQSPTGLLEHKAVNLHSEKLKEK

SEQ ID NO: 10586 - protein, 138 aa, unidentified
  REGION 1..138: note = Description of Unknown:uncultivated organism sequence
LKFNQRASLSQKGEEISINSFDNIQEEDLNRLYHVFEDKLTNKIYKVKLGKQAAVLKKGEEMFNRLSPEQKCKLIGEILHLCQCNAKHADLRLIGGAKNAGALTMTTQIYPKDHVYLIEQSVTGFFEKRILLAPFGEK

SEQ ID NO: 10587 - protein, 134 aa, unidentified
  REGION 1..134: note = Description of Unknown:uncultivated organism sequence
VKFHDRQRIMKNTLTVSDFDDISKEKNLELYDVLLSKIKDGVYGIVYSTSLKLLTEKREKFISLSVELQVELLYNELHLFQCNRVNSDLSLLGGSPNSGIILIQKTVTDKNKEYLINQSPTSLFESAPVDLYTI

SEQ ID NO: 10588 - protein, 133 aa, unidentified
  REGION 1..133: note = Description of Unknown:uncultivated organism sequence
VKFTEREKTLRKEIVPRPADGIDKENNLALFDFLSEKLSKTLYNIAYKTQAQLTSGRKETFSNLTEREQVKTLYELLHLFQCNSMLSDLSLIGGPTHTGTLLKSKEITDNDKAEIIYQSPTGLFEHSVDLLTV

SEQ ID NO: 10589 - protein, 138 aa, unidentified
  REGION 1..138: note = Description of Unknown:uncultivated organism sequence
VKAARESMEYERLRGGEGYRPNPRDGLCPEKNLALYDLFVQKMERMPYCQRMSGQRDKLLQARAAFEALDVAQQCCILCQLLNLFSRVGGEADLTGIGLVKNFGILHPSGMISGCAQALLIHQSPTGLYERVVDLNRL

SEQ ID NO: 10590 - protein, 135 aa, unidentified
  REGION 1..135: note = Description of Unknown:uncultivated organism sequence
LKFIHRKTVQKDAAITEYDGVSDDNTLALYDFFVDKLSSSIYGKKFATQADFLRQSKDKFMNLPLEERCEVLGSILHLFQCNAVLSDFHLLGGSRQAGRIYLNKKIKVQDHVYLIEQSVTGFFEKRILLAPFGEK

SEQ ID NO: 10591 - protein, 138 aa, unidentified
  REGION 1..138: note = Description of Unknown:uncultivated organism sequence
VKAARESMEYERLRGGDGYRPNPRDGLCPEKNLALYDLFVQKMERMPYCQRMSGQRDKLLQARAAFEALDVAQQCCILCQLLNLFSRSGERVDLTSIGLVKNFGVLYPSGTISGCKRALLIHQSPTGLYERVIDLNRL

SEQ ID NO: 10592 - protein, 138 aa, unidentified
  REGION 1..138: note = Description of Unknown:uncultivated organism sequence
LKYNERSSSSKGKEALLITPFDNIQEVDLNRLYQVFEDKLTNQVYKVKLGKQASVLKKGEDKFNELPLEVKCRVIGEILHLFQCNAAIADLRLIGGAKNAGALTMNPRVSPEDHVYLIEQSVTGFFEKRILLAPYGEK

SEQ ID NO: 10593 - protein, 138 aa, unidentified
  REGION 1..138: note = Description of Unknown:uncultivated organism sequence
LKFNQRAAMSKKGEEIFINSFDNIQEEDLNRLYHVFEDKLTNQIYKVKLGKQAAVLKKGEETFNRLSPEQKCKLIGEILHLCQCKATHADLRLIGGAKKAGILTMGTQIYPKDHVYLIEQSVTGFFEKRILLAPFGEK

SEQ ID NO: 10594 - protein, 133 aa, unidentified
  REGION 1..133: note = Description of Unknown:uncultivated organism sequence
VRFCEREKESKKAFTVSGFDGIEKDRNIELFDFFTKKLSSDIFMVHHEPTLKSLLANRNIFVDMSVEMQARTIYQILHIFRCNRMLADLTALQGAKSAGIVRMSKRISSKDKTMIINQSPTGLFENSVDLLTV

SEQ ID NO: 10595 - protein, 135 aa, unidentified
  REGION 1..135: note = Description of Unknown:uncultivated organism sequence
LKFNQRKQVQKELKVTVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 10596 - protein, 138 aa, unidentified
  REGION 1..138: note = Description of Unknown:uncultivated organism sequence
VKAARESMEYERLRGGEGYRPNPRDGLCSEKNLALYDLFVQKMERMPYCQRMSGQRDKLLQARAAFEALDVAQQCCILCQLLNLFSRVGGEADLTGIGLVKNFGILHPSGMISGCAQALLIHQSPTGLYERVVDLNRL

SEQ ID NO: 10597 - protein, 135 aa, unidentified
  REGION 1..135: note = Description of Unknown:uncultivated organism sequence
LKFNQRKQVQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 10598 - protein, 138 aa, unidentified
  REGION 1..138: note = Description of Unknown:uncultivated organism sequence
LKFNQRAVLSKKGEEISINPFDNIQEEDLNRLYHVFEDKLTNQIYKVKLGKQAAVLKKGEETFNRLSPEQKCKLIGEILHLCQCNATNADLRLIGGAKNAGALTMSTQIYPKDHVYLIEQSVTGFFEKRILLAPFGEK

SEQ ID NO: 10599 - protein, 138 aa, unidentified
  REGION 1..138: note = Description of Unknown:uncultivated organism sequence
LKYNERSSSSKGKEALLITPFDNIQEVDLNRLYQVFEDKLTNQVYKVKLGKQASVLKKGEGKFNELPLEVKCRVIGEILHLFQCNAAIADLRLIGGAKNAGALTMNPRVSSEDHVYLIEQSVTGFFEKRILLAPYGEK

SEQ ID NO: 10600 - protein, 135 aa, unidentified
  REGION 1..135: note = Description of Unknown:uncultivated organism sequence
LKFNQRKQVQKELKVTVHDKITEENLINIFETFISKIQTSIYRNKFKKFVSLMIKEKGTFIELSMEDKCKCIGEILHLFQCNPVLSNLQLIGGEKASGKISMGKKFDGNEKVFLILQSVTGFFEKKILLAPYEKK

SEQ ID NO: 10601 - protein, 138 aa, unidentified
  REGION 1..138: note = Description of Unknown:uncultivated organism sequence
LKFNQRASLSKKGEEISINSFDNIQEEDLNRLYHVFEDKLTNKIYKVKLGKQAAVLKKGEEMFNRLSPEQKCKLIGEILHLCQCNAKHADLRLIGGAKNAGALTMTTQIYPKDYAYLIEQSVTGFFEKRILLAPFGEK

SEQ ID NO: 10602 - protein, 133 aa, unidentified
  REGION 1..133: note = Description of Unknown:uncultivated organism sequence
VRFCEREKESKKAFTVSGFDGIEKDRNIELFDFFTKKLSSDIFMVHHAATLKSLLANRSIFVDMSVEMQARTIYQILHIFRCNRMLADLTALQGAKSAGTVLMSKKISLNDKIMIINQSPTGLFENSVDLLTV

SEQ ID NO: 10603 - protein, 138 aa, unidentified
  REGION 1..138: note = Description of Unknown:uncultivated organism sequence
VKAARESMEYERLRGGDGYRPNPRDGLCLEKNLELYNLFVQKMERMPYCQRMSGQRDKLLQARAAFEALDVAQQCCILCQILNLFSREGGEADLTGIGLVKNFGILHPSGMISGCAQALLIHQSPTGLYERVVDLNRL

SEQ ID NO: 10604 - protein, 138 aa, unidentified
  REGION 1..138: note = Description of Unknown:uncultivated organism sequence
VKAARESMEYERLRGGDGYRPNPRDGLCPEKNLALYDLFVQKMERMPYCQRMSGQRDKLLQARAAFEALDVAQQCCILCQLLNLFSRVGGEADLTGIGLVKNFGILHPSGMISGCAQALLIHQSPTGLYERVVDLNRL

SEQ ID NO: 10605 - protein, 134 aa, unidentified
  REGION 1..134: note = Description of Unknown:uncultivated organism sequence
ESFFKKSEKNKDLQPTPKFDKISTENTLDLYCELQKKSKSPIYNKRPGNQSDVLENGVSLFEKLSLLERCKAIREILNYYAMEGNGQSDFTAIGGSKTCGKLTKKAGFDITKSNILIFDQSITGLFEEIEEIKA

SEQ ID NO: 10606 - protein, 133 aa, unidentified
  REGION 1..133: note = Description of Unknown:uncultivated organism sequence
VRFCEREKENKKEFSISGFDGIETDKNVKLFDSLAVKLSNKLYSVHYAKTAKSLLSNRESFVVLSAEMQTRTIYQMLHIFQCNRMCANLEPIHGVKNAGTVLMPKKVSFSDKTLIINQSPTGLFENSVDLLTV

SEQ ID NO: 10607 - protein, 138 aa, unidentified
  REGION 1..138: note = Description of Unknown:uncultivated organism sequence
LKFNQRAVLSKKGEEISVNPFDNIQEEDLNRLYHVFEDKLTNQIYKVKLGKQAAVLKKGEETFNRLSPEQKCKLIGEILHLCQCNATNADLRLIGGAKNAGALTMSTQIYPKDHVYLIEQSVTGFFEKRILLAPFGEK

SEQ ID NO: 10608 - protein, 135 aa, unidentified
  REGION 1..135: note = Description of Unknown:uncultivated organism sequence
LKFIHRKTVQKDAVITEYDGVSDDNTLALYDFFVDKLSSSIYGKKFATQADFLRQSKDKFTNLSLEERCEVLGSILHLFQCNAVLSDFHLLGGSRQAGRIYLKKNIKAQDHVYLIEQSVTGFFEKRILLAPFGEK

SEQ ID NO: 10609 - protein, 135 aa, unidentified
  REGION 1..135: note = Description of Unknown:uncultivated organism sequence
LKFNQRKQAQKELKITVHDKITEENLINIFETFISKIQTSIYRNKFEASVGLMIKGKGTFIELSMEDKCKCIGEILHLFQCNPVLSDLQLIGGKKASGRIYMGKRFDGNKKVFLVLQSVTGFFEKKILLAPYEKK

SEQ ID NO: 10610 - protein, 133 aa, unidentified
  REGION 1..133: note = Description of Unknown:uncultivated organism sequence
VRFCEREKESKKEFTVSGFDGIEKDRNIELFDFFTKKLSSDIFMVHHAATLKSLSESRNIFVDMSVEMQARTICQILHIFRCNRMLADLTALQGAKNAGTVLMSKKISPNDKTMIINQSPTGLFENSVDLLTV

SEQ ID NO: 10611 - protein, 131 aa, unidentified
  REGION 1..131: note = Description of Unknown:uncultivated organism sequence
SKHIQELQYDKDAAVSDNGLLTEQDLDALYTELCEKLKGSVYQTMLGGYIEKYESGYEKYQKLTLEKKAQALWQMLKIFQCTPEMPDLTLIGGSKSQGAIRMGMNVTGRKSLALIHQSVTGIYERVEKIRG

SEQ ID NO: 10612 - protein, 138 aa, unidentified
  REGION 1..138: note = Description of Unknown:uncultivated organism sequence
LKFNQRAAMSKKGEEISINSFDNIQEEDLNRLYHVFEDKLTNQIYKVKLGKQAAVLKKGEETFNLLTPEQKCKLIGEILHLCQCNATHADLHLIGGAKEAGALTMSTQINPKDHVYLIEQSVTGFFEKRILLAPFGEK

SEQ ID NO: 10613 - protein, 135 aa, unidentified
  REGION 1..135: note = Description of Unknown:uncultivated organism sequence
LKFIHRKTVQKDAVITEYDGVSDDNTLALYDFFVDKLSSSIYGKKFATQADFLRQSKDKFMNLPLEERCEVLGSILHLFQCNAVLSDFHLLGGSRQAGRIYLNKKIKAQDHVYLIEQSVTGFFEKRILLAPFGEK

SEQ ID NO: 10614 - protein, 135 aa, unidentified
  REGION 1..135: note = Description of Unknown:uncultivated organism sequence
LKFIQRETVQKNAAITEYDGISNDNTSELYDFFVDKLSNSIYGKKFAAQADFLRQSKDKFMNLLLEERCEVLGSILHLFQCNPVLSDLRLLGGKKSTGTILLNKKIKPEDHVYLIEQSVTGFFEKRILLAPFGEK

SEQ ID NO: 10615 - protein, 135 aa, unidentified
  REGION 1..135: note = Description of Unknown:uncultivated organism sequence
LKFNQRKQVQKELKVTVHDKITEENLINIFEAFISKIQTSIYRNKFKKFVSLMIKEKGTFIELSMEDKCKCIGEILHLFQCNPVLSNLQLIGGEKASGKISMGKKFDGNEKVFLILQSVTGFFEKKILLAPYEKK

SEQ ID NO: 10616 - protein, 135 aa, unidentified
  REGION 1..135: note = Description of Unknown:uncultivated organism sequence
LKFNNRKAVQKDAVVTAYDGITDENTLELYDFFADKLSHSIYRKKLSAQADFLDQSKDKFAGLPLEERCEVLGAILHLFQCNAVLSDFHLLGGSRQAGRIYLNKKIKAQDHVYLIEQSVTGFFEKRILLAPYGEK

SEQ ID NO: 10617 - protein, 135 aa, unidentified
  REGION 1..135: note = Description of Unknown:uncultivated organism sequence
LKFIHRKTVQKDAVITEYDGVSDDNTLALYDFFVDKLSSSIYGKKFATQSDFLRQSKDKFMNLPLEERCEVLGSILHLFQCNAVLSDFHLLGGSRQAGRIYLNKKIKAQDHVYLIEQSVTGFFEKRILLAPFGEK

SEQ ID NO: 10618 - protein, 138 aa, unidentified
  REGION 1..138: note = Description of Unknown:uncultivated organism sequence
LKYNERASSPKRKDALLIGPFDNIREVDVNRLYQVFEDKLTNQVYKVKLGKQASVLKKGEGKFNELPLEVKCRVIGEILHLFQCNAAIADLRLIGGAKNAGALTMNPRVSPEDHVYLIEQSVTGFFEKRILLAPYGGK

SEQ ID NO: 10619 - protein, 135 aa, unidentified
  REGION 1..135: note = Description of Unknown:uncultivated organism sequence
LKFIHRKTVQKDAAITEYDGVSDDNTLALYDFFVDKLSSSIYGKKFATQADFLRQSKDKFTNLPLEERCEVLGSILHLFQCNAVLSDFHLLGGSRQAGRIYLNKKIKAQDHVYLIEQSVTGFFEKRILLAPFGEK

SEQ ID NO: 10620 - protein, 138 aa, unidentified
  REGION 1..138: note = Description of Unknown:uncultivated organism sequence
IRFCERAAISQKLHPNQPIQVNAMDGISQEENISAYVELWQKMEKLHGRLLKRLVNKLKNAQPAFQHLNIERQCYVLKQILQLWTESSSQTADLRDIGLSKDTGAISINSKISEYSEVTLFLQSVTGLFDEPVNLLKP

SEQ ID NO: 10621 - protein, 138 aa, unidentified
  REGION 1..138: note = Description of Unknown:uncultivated organism sequence
VRFCERAATAQKFHPDQPIQVNAMDGLSAEGNLAAYIALYEKLEKLHGRILSDLVKKLKEAQPAFQQQNMARQCYVLKQILRLWSASSRQTADLKDVGLSGHTGTIRVNSRISEYSEVLLIFQSVTGLFEEAVDLLKI

SEQ ID NO: 10622 - protein, 134 aa, unidentified
  REGION 1..134: note = Description of Unknown:uncultivated organism sequence
EKAFQLKQKNKLSYLPYNRNEISSEYNIMLYDFLTMKAGNPSYINRPSCQCGVLQKGHEKFEGLSIDEQLNVLQNIIRYFSSAPGMNDFSAIGGSANAGQLKFSKTVRTKGAGPKFVVIHQSITGLFEKRTVVK

SEQ ID NO: 10623 - protein, 134 aa, unidentified
  REGION 1..134: note = Description of Unknown:uncultivated organism sequence
EKAFQLKQKNKLSYLPYNRNEISSEYNIMLYDFLTMKAGNPSYINRPSCQCGVLQKGHEKFEGLCIDEQLNVLQNIIRYFSSAPGMNDFSAIGGSANAGQLKFSKTVRTKGAGPKFVVIHQSITGLFEKRTVVK

SEQ ID NO: 10624 - protein, 163 aa, unidentified
  REGION 1..163: note = Description of Unknown:uncultivated organism sequence
LKFTERFRIATAKAKKDKNSGPLDVALQLTSYDWTKSGRNTELTPEKAAEMREKDLIHLYDVFLNKLTSFYGRAFHAQISVLQNGREKYEGLPPEWKCVVLSEILHLFQCDRVLADLTLIGGSSQAGALKFSKNLKPDNQPMLITQSVTGFFEKKISLAPYRK

SEQ ID NO: 10625 - protein, 125 aa, unidentified
  REGION 1..125: note = Description of Unknown:uncultivated organism sequence
LKYNLLEQGEISDEEVLYLYDFFIDKLQNTIYSKKFDGIAKKLSSKRSKFSSLKLKDKCKVLKEVLQLFQCNSSSANLTALGCADRTGLLTIGKNISEKDHVYLIEQSITGFYEKRILLNPYEGK

SEQ ID NO: 10626 - protein, 167 aa, unidentified
  REGION 1..167: note = Description of Unknown:uncultivated organism sequence
LKFVTRLQTAESLVKHSNNKKNESKSEPAIKLTSFDWTEENRIKTISLAEAEKQRNQDMLQLYDVFLDKLSNGIYGKRLGKQADVLSNGRETFVEMIPEEKCKLLAEILHLFQCGRVPANLKPIGGAASAGLHIMNKRLDPKEHPELIVQSVTGFFEKKIPLAPYRK

SEQ ID NO: 10627 - protein, 131 aa, unidentified
  REGION 1..131: note = Description of Unknown:uncultivated organism sequence
DKVAERIREDKNYKVDEHDGITDDDMVRIYDTLYEKTKGIYKKRHSSQISILENGRETFVSMTIEDKIKQLLEILHLFQCNAVSSDLSKIGGASRAGVLVVGNEVSKYSDVRLITQSPTGLFEKEIDLLTV

SEQ ID NO: 10628 - protein, 131 aa, unidentified
  REGION 1..131: note = Description of Unknown:uncultivated organism sequence
EKTMDKMKENKKYIMNEHDKITDADLVEVYDTLSLKLHTIYAKRQSAQISILEGGREKFLLLSPEDKCRQIAEILHLFQCNTVTSDLSKIGGASNAGDLKVGNKVSRYSEAKIIAQSPTGLFEQEIDLLTI

SEQ ID NO: 10629 - protein, 131 aa, unidentified
  REGION 1..131: note = Description of Unknown:uncultivated organism sequence
DKVLDRIQDNKKYVIDNHDNIDENDLICLYDTLFGKLNKIYKKRHSVQLPVVESGREKFLEMDITAKCKFIREFLHLFQCNAVASDLSGIGGASHAGVLVIGNEISKLSDVRLITQSSTGLFETEIDLLTV

SEQ ID NO: 10630 - protein, 141 aa, unidentified
  REGION 1..141: note = Description of Unknown:uncultivated organism sequence
ARQPEEDKEAEAKPRGAFTPEDFLALYDHFTNKLGNEPYSRFSAFTNQHRNLSGSRENFIRLTPFEQTKVLGQILTLFLCDGRTSDLSLLQPKNPDGSPSTKNKQSGMLLISQNLQQGVQVIVRNYSCTGLFLSKTPLSLP

SEQ ID NO: 10631 - protein, 133 aa, unidentified
  REGION 1..133: note = Description of Unknown:uncultivated organism sequence
TSFVERLKTDKDLKINAQYDKITAAENLKLYDLLLEKNNNKIYALRPASQIKVLQEGREKFNLLSLEQQCQLILQILLLTKCAFVRADLKLLGGAGQAGTVKKNKNISDYQKAKIINESPTGFYSQEIDLLKL

SEQ ID NO: 10632 - protein, 141 aa, unidentified
  REGION 1..141: note = Description of Unknown:uncultivated organism sequence
TRQAEEGKDAEADPRAVYPPEENLALYDHFTQKLGSEPYSRLSVFVNQYRNLSASRGNFILLTPFEQMKVLGQILILFLCDGRTSDLSLLQPKNPNGTPSSKNKQSGMVTISQNLQKGIKVDVLNFSCTGLFLSRTPLSQP

SEQ ID NO: 10633 - protein, 138 aa, unidentified
  REGION 1..138: note = Description of Unknown:uncultivated organism sequence
EKYLSLLKKVKASEVLENAEILAEDLEITREANLALYDLLLAKERDSIYRNRPANQAKLLTTKQSLFTTLDIKTQCEVLVQILNLFTCTPESADLKVIGGGGRTGIVLFQSQIKDTNAQLIHRSPTGIFSKSVRVYDL

SEQ ID NO: 10634 - protein, 141 aa, unidentified
  REGION 1..141: note = Description of Unknown:uncultivated organism sequence
KTLRADVYLQAGKYSIIDVPYDMLDCTANGYVINKGKYALAKQKKKLNNTAEFCFSLYNGERFDYKDKAGICYTWIYSCIADGKNNKIEVKFIDKPSPASTQGKRLKTIGVNVCNMVKYNVDILGNEHPIKKEKFVDHFTK

SEQ ID NO: 10635 - protein, 140 aa, unidentified
  REGION 1..140: note = Description of Unknown:uncultivated organism sequence
KSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIAM

SEQ ID NO: 10636 - protein, 140 aa, unidentified
  REGION 1..140: note = Description of Unknown:uncultivated organism sequence
KSLRVDVYLDDGVYKLVNVLYDMVKNTATKYIVDEIKYEAAKTKKKISAKAEFLFSLYRGEMISYKKDGELETWIFSCMNNDKTNCVEFKFPDKPSPGNTQPKRMHTIGKKITDFTKYHVDVLGNAYPITREKLQMEIEK

SEQ ID NO: 10637 - protein, 141 aa, unidentified
  REGION 1..141: note = Description of Unknown:uncultivated organism sequence
KTLRADVYLQSGKYSIIDVPYDMLDCTANGYVINKGKYALAKQKKKLNNTAEFCFSLYNGERFDYKDKAGICYTWIYSCIADGKNNKIEVKFIDKPSPASTQGKRLKTIGVNVCNMVKYNVDILGNEHPIKKEKFVDHFTK

SEQ ID NO: 10638 - protein, 148 aa, unidentified
  REGION 1..148: note = Description of Unknown:uncultivated organism sequence
KTLRADFYLDEGIYKFVTVPYDMIKPVGTEFEIEKDKYEDAKNLKKISKKAEYLFSLHRGERFSYINKGEYFEYNYTCVKDDKRNKIEAKYYDKPQIDSKDKEKPDSKNEPPTTSVGKNISEFKKYNIDVLGNKYEVQREELRFNVSL

SEQ ID NO: 10639 - protein, 136 aa, unidentified
  REGION 1..136: note = Description of Unknown:uncultivated organism sequence
KTLRADFYLDEGIYKFVTVPYDMIKPVGTEFEIEKDKYEAAKNLKKISKKAEYLFSLHRGERFSYIDKGEYFEYNYTCVNNDKTNRLDVKYFDKPNDKQIKKTIGKNISELKKYNIDVLGNKYEVQREELRFNVSL

SEQ ID NO: 10640 - protein, 140 aa, unidentified
  REGION 1..140: note = Description of Unknown:uncultivated organism sequence
KSLRADFYYVDGAYKFINVPYDMIYKENGIYKLDMEKYQAAKVQKGINGDAEFKFSLHRGEFFSYKKDKEEFWWQFSCVNSDIKNVIETKYIDKPSPGNTQKYRMITIGKKITDMCKYNVDVLGNIYPVDKEILKVEIEM

SEQ ID NO: 10641 - protein, 140 aa, unidentified
  REGION 1..140: note = Description of Unknown:uncultivated organism sequence
KSLRADFYYVDGAYKFINVPYDMIYKENGIYKLDLEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 10642 - protein, 140 aa, unidentified
  REGION 1..140: note = Description of Unknown:uncultivated organism sequence
KSLRADFYYVDGAYKFINVPYDMIYKENGIYKLDMEKYQAAKVQKGINGDAEFKFSLHRGEFFSYKKDKEEFWWQFSCVNSDTKNVIETKYIDKPSPGNTQKYRMITIGKKITDMCKYNVDVLGNIYPVDKEILKVEIEM

SEQ ID NO: 10643 - protein, 142 aa, unidentified
  REGION 1..142: note = Description of Unknown:uncultivated organism sequence
KTLRADIYWDNNKYTFVSVPYDFIITKNNHKGGEVSYDIDLDKYNMAKVNKGISAKAKFLFSLHKGEFVSYIDKNNNYLEWYYSSVNNDSRNKIEVKEIGKPTAKQEMKTIGKDITELTKYHVDILGNRYPIKEEKLKLNNI

SEQ ID NO: 10644 - protein, 141 aa, unidentified
  REGION 1..141: note = Description of Unknown:uncultivated organism sequence
KSLRVDIYQEGERYKFVNVPYDMLKFSYGVYKIDMEKYLKSKLNKKITEQGIFLFSLYRGEVFSYEKDGVKYWWQFSCLNSDYSNVIEVKYIDKPSLSDNTRNDRKITIGSKIKNMKKHHVDVLGNIYPAGKEILQTEIKL

SEQ ID NO: 10645 - protein, 141 aa, unidentified
  REGION 1..141: note = Description of Unknown:uncultivated organism sequence
KTLRADFYLDNGKYKFISVPYDMIRVEKGVYKIDLGKYQSEKIKKKISDDATFVFSLYKGEFFSYEKDNEKFMWQYSCVNNDSKNVIETKYVDKPSPGNTQRYRMITIGNKITNMQKYNVDVLGNIYPVFKEHLKLEMDFR

SEQ ID NO: 10646 - protein, 140 aa, unidentified
  REGION 1..140: note = Description of Unknown:uncultivated organism sequence
KSFRVDIYQEGEQYKFVNVPYDMLKFPSGVYKIDMEKYLQSKQNKKITKQAIFLFSLYHGEVFSYEKEGVKYWWQFSCLNNDTSNVIEVKYMVKPSPAATQGKRMITIGSKIKNMKKYHVDVLGNIYPASKEILQTEIKL

SEQ ID NO: 10647 - protein, 140 aa, unidentified
  REGION 1..140: note = Description of Unknown:uncultivated organism sequence
KSFRVDIYQEGEQYKFVNVPYDMLKFPSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 10648 - protein, 140 aa, unidentified
  REGION 1..140: note = Description of Unknown:uncultivated organism sequence
KSFRVDIYQEGEQYKFVNVPYDMLKFSSGVYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 10649 - protein, 140 aa, unidentified
  REGION 1..140: note = Description of Unknown:uncultivated organism sequence
KSFRVDIYQEGEQYKFVNVPYDMLKFSSGVYKIDMEKYLQSKQNKKITKQAIFLFSLYHGEVFSYEKEGVKFWWQFSCLNNDTSNVIEVKYIDKPSPAATQGKRMITIGSKIKNMKKYHVDVLGNIYPASKEILQTEIKL

SEQ ID NO: 10650 - protein, 140 aa, unidentified
  REGION 1..140: note = Description of Unknown:uncultivated organism sequence
KSLRIDVYQNGEQYKFINVPYDMLKFVNGVYQIEMDKYLQAKDNKKITDVAEFKFSLYRGEFFSYEKDGKKYSWQFSCLNNDTNNVIEAKYIDQPSPGATQGKRMITIGSKIKNLRKYHVDILGNIYPATKEVLKTEIEL

SEQ ID NO: 10651 - protein, 140 aa, unidentified
  REGION 1..140: note = Description of Unknown:uncultivated organism sequence
KSFRVDIYQEGEQYKFVNVPYDMLKFSSGVYKVDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 10652 - protein, 136 aa, unidentified
  REGION 1..136: note = Description of Unknown:uncultivated organism sequence
KSLRTDIYQDGSNYLVLNVPYDMVQFTNSRYIINQGKYNEARSKQRIPASAKFVTSLYRGDYITYEESGQTVEYIFKCLNNELTHRIEVSYVDRPTDKQLLKAIKNSISNLTKYNVDVLGNKHKVSNEKLKFDVTI

SEQ ID NO: 10653 - protein, 140 aa, unidentified
  REGION 1..140: note = Description of Unknown:uncultivated organism sequence
KSFRVDIYQEGEQYKFVNVPYDMLKFSSGVYKIDMEKYLQSKQNKKITKQAIFLFSLYHGEVFSYEKEGVKYWLQFSCLNNDTSNVIEVKYIDKPSPAATQGKRMITIGSKIKNMKKYHVDVLGNIYPASKEILQTEIKL

SEQ ID NO: 10654 - protein, 140 aa, unidentified
  REGION 1..140: note = Description of Unknown:uncultivated organism sequence
KSFRVDIYQEGEQYKFVNVPYDMLKFPSGVYKIDMEKYLQSKQNKKITKQAIFLFSLYHGEVFSYEKEGVKYWLQFSCLNNDTSNVIEVKYIDKPSPAATQGKRMITIGSKIKNMKKYHVDVLGNIYPASKEILQTEIKL

SEQ ID NO: 10655 - protein, 136 aa, unidentified
  REGION 1..136: note = Description of Unknown:uncultivated organism sequence
KSLRTDIYQDGSNYLVLNVPYDMVQFTNSRYIINQDKYYEAKHMQGIPDSAEFVMSLYRGDYITYEEAGDTVEYIFKCLNSEKNHKIEVSYVDRPNDKQLMKGIKTSISNLTKYNVDVLGNKHKVTNEKLKFDVTI

SEQ ID NO: 10656 - protein, 140 aa, unidentified
  REGION 1..140: note = Description of Unknown:uncultivated organism sequence
KSFRVDIYQEGEQYKFVNVPYDMLKFSSGIYKIDMEKYLQSKQNKKITKQAIFLFSLYHGEVFSYEKEGVKYWWQFSCLNNDTSNVIEVKYIDKPSPAATQGKRMITIGSKIKNMKKYHVDVLGNIYPASKEILQTEIKL

SEQ ID NO: 10657 - protein, 114 aa, unidentified
  REGION 1..114: note = Description of Unknown:uncultivated organism sequence
DIYKPSKSDKWNFEVINMYDAHKNEIPQWRKNDARAKLVMRLYKRDTIAYEENGEYKIARVTGIATHGQISLLGLQISRVEGNPPKKMPNVLQKLNARKIYIDEIGRVYDPKKK

SEQ ID NO: 10658 - protein, 119 aa, unidentified
  REGION 1..119: note = Description of Unknown:uncultivated organism sequence
DIYLPSGEKKWAFQPVSMFEAHQKNYVPKWRKTDPHAKLVMRLFKQDILAFEEDGKTVLRKITGLATHGQISFLPLNVNHIEGNPPKISPSSLQKLNARKVYIDEAGRLFDPGKAKYSE

SEQ ID NO: 10659 - protein, 121 aa, unidentified
  REGION 1..121: note = Description of Unknown:uncultivated organism sequence
DIYLPSGEKKWHFKPVSMFEAHQKNYIPKWRKTDPHAKLVMRLFKQDILAFEENGNIVYKRITSIWGSGVIQLMPLNKNFIDKDDKRTSKTPSSLQKLNARKVYIDEAGRLFDPGKAKYSE

SEQ ID NO: 10660 - protein, 121 aa, unidentified
  REGION 1..121: note = Description of Unknown:uncultivated organism sequence
DIYLPSGEKKWHFQPVSMFEAHQKNYVPKWRKTDPHAKLVMRLFKQDILAFEENGNIVYKRITSIWGSGVIQLMPLNKNFIDKDDKRTSKTPSSLQKLNARKVYIDEAGRLFDPGKAKYSE

SEQ ID NO: 10661 - protein, 114 aa, unidentified
  REGION 1..114: note = Description of Unknown:uncultivated organism sequence
DIYKPSKSDKWSFEVINMYDAHKNEIPQWRKNDARAKLVMRLYKRDTIAYEENGEYKIARVTGIATHGQISLLGLQISRVEGNPPKKMPNVLQKLNARKIYIDEIGRVYDPKKK

SEQ ID NO: 10662 - protein, 119 aa, unidentified
  REGION 1..119: note = Description of Unknown:uncultivated organism sequence
DIYLPSGEKKWHFQPVSMFEAHQKNYVPKWRKTDPHAKLVMRLFKQDILAFEEDGKTVLRKITEIATHGQIGFLPLNVNHIEGNPPKKTPSSLQKLNARKVYIDEAGRLFDPGKAKYSE

SEQ ID NO: 10663 - protein, 146 aa, unidentified
  REGION 1..146: note = Description of Unknown:uncultivated organism sequence
DFYRKNGKYYAVPVYVKDMVKDHLPDRAVTLKHPYDQWDKMDDNDFLFSLYPNDVVYIKFNVKNNKYQELHLVNKDSTLPEKKEFRELHGYYKSFDIATNSIKIITDDNCYYGKGIGIKTLPEIKKCAVDVLGNLIPVARETRKHR

SEQ ID NO: 10664 - protein, 144 aa, unidentified
  REGION 1..144: note = Description of Unknown:uncultivated organism sequence
DVFYIDGEGYYLVPIYVTDTIKSELPNKAIVAHKPYEQWKEMNDNDFLFSLYKNDLIKVISKKDMTFSLKNKESKLASTYSTKEEFVYFKSVNISSGAFTVINHDNSYSICSLGAKTLLSIEKYQVDFLGNKFKVNKERRQRFK

SEQ ID NO: 10665 - protein, 141 aa, unidentified
  REGION 1..141: note = Description of Unknown:uncultivated organism sequence
DLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIQSLGIKTLNCIEKYHVDVLGNKYKAAVEERK

SEQ ID NO: 10666 - protein, 146 aa, unidentified
  REGION 1..146: note = Description of Unknown:uncultivated organism sequence
DVFYVEGEGYYFVPIYVDDTLKKDLPDRAIVQRKPMKEWKQMDDKNFIFSLYPDDLVKIVFPNNKTFKIKKELAKAGSTLPKEIVLKEGLFYYQGVNISSGNITVESNDGTYYSEPGPRKLISLEKYEVDVLGNIHKVNKEKRMGF

SEQ ID NO: 10667 - protein, 165 aa, unidentified
  REGION 1..165: note = Description of Unknown:uncultivated organism sequence
DLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNCIEKYHVDVLGNKYKAAVGRGNNGRCQRVGEQVRTRFLYHHLLKSI

SEQ ID NO: 10668 - protein, 141 aa, unidentified
  REGION 1..141: note = Description of Unknown:uncultivated organism sequence
DLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNCIEKYHVDVLGNKYKAAVEERK

SEQ ID NO: 10669 - protein, 141 aa, unidentified
  REGION 1..141: note = Description of Unknown:uncultivated organism sequence
DLYYVEGEGYYFIPIYISDLMKEELPKKACVSNKEYHDWKNMKDEDFLYSIYPNDLLHIKSSTPKKFTKNIQKGKENDSFEAEEAFVYYIKAGIGTGSITVVTHDNNYTIKSLGIKTLNFIEKYHVDVLGNKYKAAVEERK

SEQ ID NO: 10670 - protein, 139 aa, unidentified
  REGION 1..139: note = Description of Unknown:uncultivated organism sequence
DLYYVEGEGYYFIPIYISDLMKEELPKKACVPHKEYHDWKNMKDEDFLYSIYPNDLLYIKSSTPKKFAKKRGEKKDFFEAEEAFVYYREAGISGATITVETHDNNYTIQSLGVKTLSRIEKYYVDVLGNKYKAAVEERK

SEQ ID NO: 10671 - protein, 142 aa, unidentified
  REGION 1..142: note = Description of Unknown:uncultivated organism sequence
DFYRKNGKYYAVPVYVKDMVNDHLPDRAVTLKHPYDQWDKMDDNDFLFSLYPNDVVYIRFNKPKNGKVVNEDSTLNKNESFDEIYGYYKALGIATNSITVITNDNSYRLDSIGIKTLPEIKKCAVDVLGNLIPVARETRKHR

SEQ ID NO: 10672 - protein, 140 aa, unidentified
  REGION 1..140: note = Description of Unknown:uncultivated organism sequence
DVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 10673 - protein, 140 aa, unidentified
  REGION 1..140: note = Description of Unknown:uncultivated organism sequence
DVFRTEDGYYLVPIYVADTVKNELPHKAIVQGGEWKAMNDEDFLFSLYRNDLIKIKSNSDVTFSLMNESSSLPKTESLREEFVYFKGTSINTASIRVVTYDNCYIKKSLGVKNLQSLEKYQVDVLGNVSKVKKEKRMGFR

SEQ ID NO: 10674 - protein, 140 aa, unidentified
  REGION 1..140: note = Description of Unknown:uncultivated organism sequence
DVFRTEDGYYLVPIYVADTVKNELPHKAIVQGGEWKVMNDEDFLFSLYRNDLIKIKSNSDVTFSLMNESSSLPKTESLREEFVYFKGTSINTASIRVVTHDNCYIKKSLGVKNLQSLEKYQVDVLGNVSKVKKEKRMGFR

SEQ ID NO: 10675 - protein, 21 aa, unidentified
  REGION 1..21: note = Description of Unknown:uncultivated organism sequence
DVFYVEGEGYYLVPIYVADTV

SEQ ID NO: 10676 - protein, 134 aa, unidentified
  REGION 1..134: note = Description of Unknown:uncultivated organism sequence
DVYRKNSKYCMVPVYAWQIERDIIPRHAVNAYKRESEWELMDETAKYLYHFQFDDLIQVDTGKSKIAGYFNGFDRSTGAIHIEVHDRNLKQGKNGLFRSIGVKSAKSLQKFQIDVLGRYWPIDKEVPPWAGAAS

SEQ ID NO: 10677 - protein, 191 aa, unidentified
  REGION 1..191: note = Description of Unknown:uncultivated organism sequence
EIYKYEGSYWFRARYQVAKEKTFGLPVMPVGAEFICNLTKNEYIRIKHPNLVHCYREVSRYTDSLGNILINVEAIFDNGIFEGYWNNFEPSAKRPVLYLQDKKSFFLLEDGKVLDKKILILIAKPKAKQASKEQVELEYLEFTEGQPQEKPLKFDLKVGRDAVIQRGIKDAAFIEKIKVSVLGSLQKNLKE

SEQ ID NO: 10678 - protein, 184 aa, unidentified
  REGION 1..184: note = Description of Unknown:uncultivated organism sequence
EMYRYNGTYWFRPRYKISEEASFGLPVMPRGAQHVCNFRKNDFVRIKHPNMAHCYRETRRYRNTNGDTIIEVSAISLDGVFEGYWNYFEPSNDRPVVQLHDASTFFLLEDGKTLKSQSLLLIAKSKAKKAKTKGIDELEYFEFGDVQQDRPLKFSQVRDIKRKVGDAAFIEKVKIDVLGVIDGR

SEQ ID NO: 10679 - protein, 108 aa, unidentified
  REGION 1..108: note = Description of Unknown:uncultivated organism sequence
EVYWAGESYFFRPRYKAPEQKLFGIANPPKGARPIFAVTQNDLIEVILDDGTQRLGYFVMYEGDGRLQIRDHDQAKKNAHRFGISRIRHLKKLKVSVLGEISDVSSLD

SEQ ID NO: 10680 - protein, 145 aa, unidentified
  REGION 1..145: note = Description of Unknown:uncultivated organism sequence
EVWLTENGFFFRPRYQAAEEATFGLEEPPTDAKHLFNLRIDEPVEIVLMDGEIIPGDGFPGYFVVYEGDGRIQIRTHDRPGKGKRKKEKSEEAAESTDTAVKNEDEKDNSLRRFSINGIKELKKYRVDALGNYKLVAHAKWSGVA

SEQ ID NO: 10681 - protein, 152 aa, unidentified
  REGION 1..152: note = Description of Unknown:uncultivated organism sequence
EVYWVEGSGYFFRQRYAVDEEATFGQEKPPANAQHFFNLRIDEPVQVVMKDGTTFPASRPGYFVGYEADKRMTIRVHDRPGKGRKKSKETGDEVNDGQAEESPASIIDGEKSGKDSTLFRFSVSGIKKLRKFKVDALGNYRELHAHLHHGLA

SEQ ID NO: 10682 - protein, 192 aa, unidentified
  REGION 1..192: note = Description of Unknown:uncultivated organism sequence
EMYKHDGAYWFRARYKVAQENSFGLPVMPKGAQHIGNFMKNDYVRIKHPNLTHCYREVGRHKDAYGNTLIDVEAIFENGIFEGYWNYFEPSNDRPVVQLHDNSPFFLLEAEKTLDKESLTLIAKPKEKKNSKAKTTEQVEYFEFCETPQDPPLKFSLVGDIKRKVSDAAFIEKLKVSILGSIQEGKDANDLA

SEQ ID NO: 10683 - protein, 125 aa, unidentified
  REGION 1..125: note = Description of Unknown:uncultivated organism sequence
VIFEHTAEGKKKGGWDGEVVSMFEAAQRIRRHEPIIRRDLGEGKKFVMSLSINEIVKVTENGESAYWRVQKIDAGNMRVTFRPQNDARKSEDKSFEKTIGVGPLKKLAPAKVTIDPVGREHPAHD

SEQ ID NO: 10684 - protein, 120 aa, unidentified
  REGION 1..120: note = Description of Unknown:uncultivated organism sequence
VIYEYEDKKGRSKRGGHVVSMFEAAQRARRGEPIIQRKLVDGQRFVMSLSINELVQVPTGENEFEVYRVQKMNSDLTICLRSHTSAIITDKATRRFVKPNTLNGRKVVIDPIGRVYPAND

SEQ ID NO: 10685 - protein, 120 aa, unidentified
  REGION 1..120: note = Description of Unknown:uncultivated organism sequence
VIYEYQDKRGKTKRGGHVVSMFEAAQRARRGEPIIQRKLEDGQKFIMSLSINELVQVPKGEDEFDVYRVQQISLDTKMMLRLDKAASLGNNDERLIKMPNTLKGQKIVIDPLGKIYPAND

SEQ ID NO: 10686 - protein, 127 aa, unidentified
  REGION 1..127: note = Description of Unknown:uncultivated organism sequence
EIFEYKDKKEQTKRDGKVITMFKAVQRSQRGESVVCRDYKNGKNFVCSLAQNELFMIYLNDDSTELHRVQKITQSGNNITITLRPHTYAGKVSDFDKPPLVQRRTPNTLKGHKVTVDMLGRVHLAND

SEQ ID NO: 10687 - protein, 120 aa, unidentified
  REGION 1..120: note = Description of Unknown:uncultivated organism sequence
EIYEYTDGKKKGKRDGEVVTMFEAIRRKKDGEPVVNREHGPDKKFVCSLSINEMFMLESDNKEYYLCRIQKMSQNKVIVLRPHTFAGNLKKQKPINKTPNSLKGYKVTVDPLGRIHRAND

SEQ ID NO: 10688 - protein, 124 aa, unidentified
  REGION 1..124: note = Description of Unknown:uncultivated organism sequence
EIFEYTDAKGKTRREGRVISMFEAVQRSRRKEPVVCRDYGDGGKFVCSLSKNESFMLKMDDGNFVLHRVQKIIQDGRIVLRPALFGGKVSDSDSPPLIQRRNYSTLDGYKVSVDPIGRIFPAKD

SEQ ID NO: 10689 - protein, 124 aa, unidentified
  REGION 1..124: note = Description of Unknown:uncultivated organism sequence
EIFEYTDKKGQVKRDGTVVSMFDAVQRSQRGEPVVFRDYGDGGKFVWSLAINEMFMLETDSGQHVLHRVQKMDQNKRVTLRPHTYSGKLSDYDVSPLIQRKSPGTLRGYKVMVDPLGGIWPAND

SEQ ID NO: 10690 - protein, 120 aa, unidentified
  REGION 1..120: note = Description of Unknown:uncultivated organism sequence
EIFERTDKNGCIKRDSKVITMFEAVQRSQKGEPVVKRDYGDGKKFVCSLSINDMVMMKNKAGETDLYRVQKMDANKMVRFRHHTASNLDRKETYIDKTAHLFEGYKVTVDPLGRVLLAND

SEQ ID NO: 10691 - protein, 120 aa, unidentified
  REGION 1..120: note = Description of Unknown:uncultivated organism sequence
VIYEYEDKKGKTKRGGVVVSMFDAAERAKTGKPIIQRELGEGKRFVMSFSINELVQVPKREDGFDVYRVQKMNAATQITLRLHTAANINDNSARLLVQPNTFKGSKVVIDPLGNMFPAND

SEQ ID NO: 10692 - protein, 127 aa, unidentified
  REGION 1..127: note = Description of Unknown:uncultivated organism sequence
AVYEKDAGAWTGRIVSRFEAYRRRREGLPIVSREPLDGMGFVMSLCLRDMLLMQDPDTGRDELWVVKAFSVGKTPRFQPDIQIIRHTTAHPGKHGDLRITNWETKFRKLNPRKVSVDPIGRISACND

SEQ ID NO: 10693 - protein, 124 aa, unidentified
  REGION 1..124: note = Description of Unknown:uncultivated organism sequence
EIFEYKDKKGNIKRDGKVVTMFKAVQRSQHEEPVVQTNHGADKKFIFSLAINDMFNLELEDGSKILHRVQKIDKNNRIILRPHTYSGKVSDYDKPPSIQRKSASTLLGCKVTVDPLGKIWPAND

SEQ ID NO: 10694 - protein, 124 aa, unidentified
  REGION 1..124: note = Description of Unknown:uncultivated organism sequence
EIFEYKDKKGRTKRNGNVITMFEAVRRSQRSEPVVQKDHGPNKKFIFSLARNEMVMLDIGDGKEILHRVQKIIQDGRVIFRPHTFGGKLSDSDQPPSIQRKSASTLKGYKVIVDPLGRIYRAND

SEQ ID NO: 10695 - protein, 127 aa, unidentified
  REGION 1..127: note = Description of Unknown:uncultivated organism sequence
EIFEYTDKKGNVKRDGKVISMFDAIQRGQRGESVVCKDYNDGKNFVCSLAQNESFMLELDEDSTELHRVQKITQSGNNITITLRPHTYSRKVSDSDKPPLVQRRTPNTLKGHKVTVDMLGRVHMAND

SEQ ID NO: 10696 - protein, 120 aa, unidentified
  REGION 1..120: note = Description of Unknown:uncultivated organism sequence
EIWEYTEGPKKGKRDAEVVSMFEVVNRSRRGEEVVNREHGVAMRFVCSLAINDMVMLSNNYGEMDLFRVQKMNVNKQVYFRHHTASQIDDDTTVIRKQANLFDGYKVTVDPLGRVWPAND

SEQ ID NO: 10697 - protein, 120 aa, unidentified
  REGION 1..120: note = Description of Unknown:uncultivated organism sequence
EIFEYTDKRGNIKREGKVITMFEAVQRSQQGEPIVKRDYSDGKKFVCSLAINEMFMLEMDNGLEELYRVQKISQNGQIYLRPHTYAGDLKKQKGISKLPNKLKGHKVTVDMLGRVHMAND

SEQ ID NO: 10698 - protein, 120 aa, unidentified
  REGION 1..120: note = Description of Unknown:uncultivated organism sequence
EIWEYTEGEKKGKRESVVVTMFEAVRRSCNGEPVVQRNRGLGTRFVCSLAINDMVMMKNKAGEMDLYRIQKMDANKIVRFRHHTAAKIDKKETYIDKTAHLFDGYKVTLDPLGRIYAAND

SEQ ID NO: 10699 - protein, 124 aa, unidentified
  REGION 1..124: note = Description of Unknown:uncultivated organism sequence
EIFEYTDRKGRLKQEGRVITMFEAVQRSRNKQPVICRDYGDGKRFVCSLAINESFMLEVEDGGLVLHRVQKLDQNGRIILRPHTFGGKLKDNDSPPLIQRKSPNTLRGYKVTVDPIGRIFPAKD

SEQ ID NO: 10700 - protein, 127 aa, unidentified
  REGION 1..127: note = Description of Unknown:uncultivated organism sequence
EIFEYTDSKGRTKREGRVISMFEAVQRSRRKEPVVCRDYGDGGRFICSLSRNESFMLEMDDGTHVLHRVQYISILPGGPRIVLRPAAFGGQLSEKHKAPLIQRKMPNSLKGYKVAVDPIGRIFPAKD

SEQ ID NO: 10701 - protein, 123 aa, unidentified
  REGION 1..123: note = Description of Unknown:uncultivated organism sequence
EIFEYTDKKGNIKRDGIVVSMFEAVHRSRAGKPVVCRDYGDGRKFVCSLAKNEMFMLEVDGEYILHRVQKIIQDGRIVLRPHTFAGQVSDSDNPPFVQRKNYNTLQGYKVFVDPLGRIFPAKD

SEQ ID NO: 10702 - protein, 124 aa, unidentified
  REGION 1..124: note = Description of Unknown:uncultivated organism sequence
EIFEYTDAKGRTKRQGRVVSMFEAVQRSRRKEPVICRDYGDGGKFVCSLSRNESFMLELDDGKHVLHRVQKIDQNERIILRPHTFGGKLQDSDKPPLIQRKSPNTLNGYKVTVDPIGRIFPAKD

SEQ ID NO: 10703 - protein, 124 aa, unidentified
  REGION 1..124: note = Description of Unknown:uncultivated organism sequence
EIFEYTDRKGRLKQEGRVITMFEAVQRSRNKQPVICRDYGDGKRFVCSLAINESFMLEVEEGSFVLHRVQKLDQNGRIILRPHTFGGKLEDSDSPPLIQRKSPNTLRGYKVTVDPIGRIFPAKD

SEQ ID NO: 10704 - protein, 120 aa, unidentified
  REGION 1..120: note = Description of Unknown:uncultivated organism sequence
VIYEYEDKRDITKRGGIVVSMFDAAERARHGKAVIQRNLEDGKRFVMSLSINELVEVPIGEDESEVYRVQKMNAATQICLRKHTAANINDHSSRMLVMPNTFNGKKVVVDPLGKIYPAND

SEQ ID NO: 10705 - protein, 131 aa, unidentified
  REGION 1..131: note = Description of Unknown:uncultivated organism sequence
DIYCATKGKDAGKWKCEIISTYSANQKDFVPEWRRRDPHAKLIMKLHINDMVAYDELNKGTGQTERVIARVKKMTSGLVFLRGHLIAKEEGDKLSWGASANQMQEKNLRKVYVDAMGKVKDPMFKNERKVS

SEQ ID NO: 10706 - protein, 131 aa, unidentified
  REGION 1..131: note = Description of Unknown:uncultivated organism sequence
DIYCATKGKDAGKWKCEIISTYSANQKDFVPEWRRRDPHAKLIMKLHINDMVAYDELNKETGQTERVIARVKKMTSGLVYFRSHLIAKEEADKLSWGASANQMQEKNLRKVYVDAMGKVKDPMFKNERKVS

SEQ ID NO: 10707 - protein, 131 aa, unidentified
  REGION 1..131: note = Description of Unknown:uncultivated organism sequence
DIYCATKGKDAGKWKCEIISTYSANQKDFVPEWRRRDPHAKLIMKLHINDMVAYDELNKETGQTERVIARVKKMTKGLVFLRGHLIAKEEGDKLSWGASANQMQEKNLRKVYVDAMGKVKDPMFKNERKVS

SEQ ID NO: 10708 - protein, 131 aa, unidentified
  REGION 1..131: note = Description of Unknown:uncultivated organism sequence
DIYCATKGKDAGKWKCEIISTYSANQKDFVPEWRRRDPHAKLIMKLHINDMVAYEELNKETGQTERVIARVKKMTSGLVFLRGHLIAKEEGDKLSWGASANQMQEKNLRKVYVDAMGKVKDPMFKNERKVS

SEQ ID NO: 10709 - protein, 119 aa, unidentified
  REGION 1..119: note = Description of Unknown:uncultivated organism sequence
DIYCPDKGKKEGKWQVEIIPMFYAHQINFIPNWQKKNPTAKKIMRLYINDTVAYEENGRTEIRRVKKMTIDGRLFFINHIIAKIDKDPNATSVKQMQEKGYRKVGVDILGRVSDPKKAK

SEQ ID NO: 10710 - protein, 119 aa, unidentified
  REGION 1..119: note = Description of Unknown:uncultivated organism sequence
DIYCPDKGKKAGKWQIEIIPMFYAHQTNFIPDWQKANPTAKKIMRLYINDTVAYEENGETVIRRVKKMNIDGRLFFIDHKIAKSDKDPNATSVKQLQEKDGRKVGVDILGRVSDPKRAK

SEQ ID NO: 10711 - protein, 151 aa, unidentified
  REGION 1..151: note = Description of Unknown:uncultivated organism sequence
LKHETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 10712 - protein, 151 aa, unidentified
  REGION 1..151: note = Description of Unknown:uncultivated organism sequence
LKYENDIAENELVIADKNSDDIQKQQAQKNLDYYNQKWRIGIKVNMHIYDMLLAKSGNNLYKNRPASQTTDLQEQREFFEKLSLANQIHVIGEVLKLFKCASASANLKLLDKGNACGVIKVSNNILKFKQCVLINQSPTGVFEQEVDLMKL

SEQ ID NO: 10713 - protein, 136 aa, unidentified
  REGION 1..136: note = Description of Unknown:uncultivated organism sequence
DVFYKNGTYFLVPVYTIDFTKEKLPLISIPDNQPMDVRDFRFSLYKDDYVQIKNKTGETFEGYFKQYNAQTGQIYLETHDRSDSYTVSGKPASEKKFSKSTFVDFTKYQIDILGNQHRVEKEKYTGITRKNKGFGG

SEQ ID NO: 10714 - protein, 136 aa, unidentified
  REGION 1..136: note = Description of Unknown:uncultivated organism sequence
DVFLEDGQYYVVPVYTMDFAKGVLPLVAQPSGRLMKKENFVFSLYKDDYVNLVNKQGETWEGYFKQLNAQTGQIYLESHDRSAQYTVSGKPSNQKKIASSTLKLIEKYQIDIFGGKHLVKKEKYIGIIRKNKGFGG

SEQ ID NO: 10715 - protein, 136 aa, unidentified
  REGION 1..136: note = Description of Unknown:uncultivated organism sequence
DVFLEDGQYYVVPVYTMDFAKGVLPLVAQPSGRLMKKENFVFSLYKDDYVNLVNKQGETWEGYFKQYDATTSQIHLESHDRSAQYTVSGQLTNKKKIASSTLKLIEKYQIDIFGGKHLVKKEKYIGIIRKNKGFGG

SEQ ID NO: 10716 - protein, 136 aa, unidentified
  REGION 1..136: note = Description of Unknown:uncultivated organism sequence
DVFLEDGQYYVVPVYTMDFAKGVLPLVAQPSGRLMKKENFVFSLYKDDYVNLVNKQGEIWEGYFKQLNAQTGQIYLESHDRSAQYTVSGKPSNQKKIASSTLKLIEKYQIDIFGGKHLVKKEKYIGIIRKNKGFGG

SEQ ID NO: 10717 - protein, 136 aa, unidentified
  REGION 1..136: note = Description of Unknown:uncultivated organism sequence
DVFLEDGQYYVVPVYTMDFAKGVLPLVAQPSGRLMKKENFVFSLYKDDYVNLVNKQGETWEGYFKQLNAQTGQIYLESHDRSAQYTVSGKLSNQKKIASSTLKLIEKYQIDIFGGKHLVKKEKYIGIIRKNKGFGG

SEQ ID NO: 10718 - protein, 136 aa, unidentified
  REGION 1..136: note = Description of Unknown:uncultivated organism sequence
DVFYKNGKYYLVPIYTIDFAKQELPLLSVPDNVPMDPKDFIFSLYKDDYIELKNKNGETYEGYFSQYNAQSGQIYLESHDRSATYTVSGKPSSEKKLNKNTFISFTKYQIDILGGKHAIKKEKYVGIRRKNKGFGG

SEQ ID NO: 10719 - protein, 128 aa, unidentified
  REGION 1..128: note = Description of Unknown:uncultivated organism sequence
DIYSRDGKFYMVPVYAKDVADKRLPLRACVAAKAEKDWREMTADYRFLFSLTPDCYVLTENRKGEVKEGYFAGANRNTSAISLSLAHDKQNVIQGIGITTLKRFEKYRVDRFGRLSLVRREADPRGRS

SEQ ID NO: 10720 - protein, 128 aa, unidentified
  REGION 1..128: note = Description of Unknown:uncultivated organism sequence
DIYSRDGKFYMVPVYAKDVADKRLPLRACVAAKAEKDWREMTADYRFLFSLTPDCYVLTENRKGEVKEGYFVGSDRSTAAISLSLAHDRQQSLRGIGITTLKRFEKYRVDRFGRLSPVRREADPRGRS

SEQ ID NO: 10721 - protein, 128 aa, unidentified
  REGION 1..128: note = Description of Unknown:uncultivated organism sequence
DIYSRDGKFYMVPVYAKDVADKRLPLRACVAHKDEKDWREMTADYRFLFSLTPDCYVLTENRKGEVKEGYFAGANRNTSAISLSLAHDKQNVIQGIGITTLKRFEKYRVDRFGRLSPVRREADPRGRS

SEQ ID NO: 10722 - protein, 128 aa, unidentified
  REGION 1..128: note = Description of Unknown:uncultivated organism sequence
DIYSRDGKFYMVPVYAKDVADKRLPLRACVAAKAEKDWREMTADYRFLFSLTPDCYVLTENRKGEVKEGYFAGANRNTSAISLSLAHDKQNVIQGIGITTLKRFEKYRVDRFGRLSPVRREADPRGRS

SEQ ID NO: 10723 - protein, 128 aa, unidentified
  REGION 1..128: note = Description of Unknown:uncultivated organism sequence
DIYSRDGKFYMVPVYAKDVADRRLPLRACVAAKAEKDWREMTADYRFLFSLTPDCYVLTENRKGEVKEGYFIGSDRSTAAISLSLAHDRQQSLRGIGITTLKRFEKYRVDRFGRLSPVRREADPRGRS

SEQ ID NO: 10724 - protein, 128 aa, unidentified
  REGION 1..128: note = Description of Unknown:uncultivated organism sequence
DIYSRDGKFYMVPVYAKDVADRRLPLRACVAAKAEKDWREMTADYRFLFSLTPDCYVLTENRKGEVKEGYFIGSDRSTAAISLSLAHDRQQSLRGIGITTLKRFEKYRVDRFGRLSSVRREADPRGRS

SEQ ID NO: 10725 - protein, 128 aa, unidentified
  REGION 1..128: note = Description of Unknown:uncultivated organism sequence
DIYSRDGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRS

SEQ ID NO: 10726 - protein, 103 aa, unidentified
  REGION 1..103: note = Description of Unknown:uncultivated organism sequence
DIYSRDGKFYMVPVYAKDVADKRLPLRACVAAKAEKDWREMTADYRFLFSLTPDCYVLTENRKGEVKEGYFAGANRNTSAISLSLAHDKQNVIQHRHHHVKAF

SEQ ID NO: 10727 - protein, 128 aa, unidentified
  REGION 1..128: note = Description of Unknown:uncultivated organism sequence
DIYSRDGKFYMVPVYAKDVADKRLPLRACVAAKAEKDWREMTADYRFLFSLTPDCYVLTENRKGEVKEGYFAGANRNTSAISLSLAHDKQHVIQGIGITTLKRFEKYRVDRFGRLSLVRREADPRGRS

SEQ ID NO: 10728 - protein, 128 aa, unidentified
  REGION 1..128: note = Description of Unknown:uncultivated organism sequence
DIYSRDGKFYMVPVYAKDVADKRLPLRACVAHKDEKDWPEMTADYRFLFSLTPDCYVLTENRKGEIKEGYFSGADRSSANISLTLAHDRKSSIRGIGIQKLRRFEKYRVDRFGRLSPVRREADPRGRS

SEQ ID NO: 10729 - protein, 128 aa, unidentified
  REGION 1..128: note = Description of Unknown:uncultivated organism sequence
DIYSRDGKFYMVPVYAKDVADKRLPLRACVAAKAEKDWREMTADYRFLFSLTPDCYVLTENRKGEVKKGYFAGANRNTSAISLSLAHDKQNVIQGIGITTLKRFEKYRVDRFGRLSLVRREADPRGRS

SEQ ID NO: 10730 - protein, 128 aa, unidentified
  REGION 1..128: note = Description of Unknown:uncultivated organism sequence
DIYSRDGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRP

SEQ ID NO: 10731 - protein, 128 aa, unidentified
  REGION 1..128: note = Description of Unknown:uncultivated organism sequence
DIYSRNGKFYMVPVYAKDVADKRLPLRACVAAKAEKDWREMTADYRFLFSLTPDCYVLTENRKGEVKEGYFAGANRNTSAISLSLAHDKQNVIQGIGITTLKRFEKYRVDRFGRLSLVRREADPRGRS

SEQ ID NO: 10732 - protein, 128 aa, unidentified
  REGION 1..128: note = Description of Unknown:uncultivated organism sequence
DIYSRNGKFYMVPVYAKDVADKRLPLRACVAHKDEKDWLELTEDYHFLFSLTPDCYVLTENRKGEVKEGYFEGPDRGSANISLSLAHDKKNTIRGIGIQNLKRFEKYRVDRFGRLSLVRREADPRGRL

SEQ ID NO: 10733 - protein, 136 aa, unidentified
  REGION 1..136: note = Description of Unknown:uncultivated organism sequence
RAFKKDKKLEYKRIDVSNFEKIKKSNDGSFKVYKNDIVFFVFDEEKYKGGKIVSFLEDKKMAAFSNPKYPANIQAQPESFLTIFKGKANSHKQVSVGKAKGIIKLKVDILGNIESYQVLGNAKSKLLDEIKSIVSH

SEQ ID NO: 10734 - protein, 136 aa, unidentified
  REGION 1..136: note = Description of Unknown:uncultivated organism sequence
KAQIINGKLNYTRIDVANIDKIKKENDNSFKVYKNDLVFFIYTDGTNKGGKIVSFLEDKRIAAFSNPRFPSSIGFQPHFFVTIFNGKANSHKQHSLNKAIGIIKLNLDILGNIKSYQKIGSCESELLEFIKKVIKD

SEQ ID NO: 10735 - protein, 138 aa, unidentified
  REGION 1..138: note = Description of Unknown:uncultivated organism sequence
KTYLEKDKLKYNRIDISNTQKINGKFVVYSKGFKVFKNNLVFFIFSDGTYKGGKIVSFLADKGIAAFSNSKFPASIANQPHSFLTFFNGKPNSHKQHSINKAIGLIKLDLDILGNIKSQQTIGNVQSKLFDFIKEILK

SEQ ID NO: 10736 - protein, 139 aa, unidentified
  REGION 1..139: note = Description of Unknown:uncultivated organism sequence
KAVLEKEKLVYERIDASNFKRIKKENDASFKVFKNDVVFFVFSDNTFRGGKLVSFLEDGTIASFQNPRYPAAVQFQPSLFCILGKDKEGNPKKSSSKQYKNGKAIGIIKLNLDILGNIKSYSKFGEVSQEVEKSIFHKE

SEQ ID NO: 10737 - protein, 134 aa, unidentified
  REGION 1..134: note = Description of Unknown:uncultivated organism sequence
KATLKNKKLGYERIDASNFRKIQKINDGSFKVYKNDVVFFVYEDDNFKGGKIVSFLEDKKMGSFSNPRYPASIKFQPHSFLTLFKGVPNSHKQHSLNKAIGIIKLNLDILGNIKSYSKFGEVSKEVELKIFYKE

SEQ ID NO: 10738 - protein, 134 aa, unidentified
  REGION 1..134: note = Description of Unknown:uncultivated organism sequence
RATSNNEKLFYERIDASNFKRIQKENDGSFKVYKNDVVFFIYEDEIFKGGKIVSFLEDKKIASFSNPRYPASIKFQPHSFLTLFKGIPNSHKQYSLNKAIGIIKLNLDILGNIKSYSKFGVVSKEVELKIFHKE

SEQ ID NO: 10739 - protein, 137 aa, unidentified
  REGION 1..137: note = Description of Unknown:uncultivated organism sequence
QSWLENEKLHYKRIDVANFKKIKKQNDGNFQVFKNDIVFFVYPNGSFRGGKIVSFLEENKTGAFQNSKFPMSLKYQPEIFCELNKEKKHVKTKPRSIGKSTGIIKLNLDIIGNIKSYTCIGKIESEILDFIKASVNG

SEQ ID NO: 10740 - protein, 134 aa, unidentified
  REGION 1..134: note = Description of Unknown:uncultivated organism sequence
KAELKDDKLCYERIDVANFNTIKKENDKSFKAYKNDVIFFMYGDGSFRGGKIVSFLEDKKIAAFSNPKFPVSYKFQPDSFCKDKAHTGAKQHALNKAIGIIKLNLDITGKIKSYQSIGTIESELLQFIKEAIHG

SEQ ID NO: 10741 - protein, 133 aa, unidentified
  REGION 1..133: note = Description of Unknown:uncultivated organism sequence
SAILNGKKIKYKRIDVANFESMKKVDGFKVYKNDVVFFIYPDGSFNGGKIVSFLEDKKMASFSNPRFPANIGLQPHSFVTLFKGKANSHKQHSLNKAIGIIKLNLNVLGNIKSFSSMDEVDGELLEFLKGLKG

SEQ ID NO: 10742 - protein, 133 aa, unidentified
  REGION 1..133: note = Description of Unknown:uncultivated organism sequence
SAILNGKKIKYKRIDVANFESMKKVDGFKVYKNDVVFFIYPDGSFKGGKIVSFLEDKKMASFSNPRFPANIGLQPHSFVTLFKGKANSHKQHSLNKAIGIIKLNLNVLGNIKSFSSMDEVDGELLEFLKELKG

SEQ ID NO: 10743 - protein, 136 aa, unidentified
  REGION 1..136: note = Description of Unknown:uncultivated organism sequence
RTWLKEGKLNYERIDVANLQKIEKLNDSSFKVYKNDEIFFIMPDGSRRGGKIVSFLEETKKSAFQNAKYPTSSEYQPMPFCKMNKGKKSGAKQQSIGKAIGIIKLNLDIIGNIKSYQVIGDAKSDFLDFVKESIRG

SEQ ID NO: 10744 - protein, 139 aa, unidentified
  REGION 1..139: note = Description of Unknown:uncultivated organism sequence
RAYKEDSKLEYERIDVANVEKIQKTNDGSFKAYKNDIVFFIYNDGSFKGGRVVSYIKKSSGSKLCAFLNPRFPTASEYQPSSFCKIEKGKHSGAKQQSIGSAKGIIKLNLDTLGNIKSYQVLGNVESKILDEIKSIVSH

SEQ ID NO: 10745 - protein, 135 aa, unidentified
  REGION 1..135: note = Description of Unknown:uncultivated organism sequence
KATLKDSKLKYTRIDVANFEKIQKENTDSFKVFKNDLVFFIYSDGSFRGGKIVSFLEEKGMGAFSNSRFPASIGLQPHSFLTMFNGKANSHKQISLNKAIGIIKLNIDIIGNIKSYQVIGDVKGELLEFIKKLTQ

SEQ ID NO: 10746 - protein, 133 aa, unidentified
  REGION 1..133: note = Description of Unknown:uncultivated organism sequence
SAILNGKKIKYKRIDVANFESMKKVDGFKVYKNDVVFFIYPDGSFKGGKIVSFLEDKKMASFSNPRFPANIGLQPHSFVTLFKGKANSHKQHSLNKAIGIIKLNLNVLGNIKSFSSMGEVDGELLEFLKGLKG

SEQ ID NO: 10747 - protein, 141 aa, unidentified
  REGION 1..141: note = Description of Unknown:uncultivated organism sequence
RAIKKGEKLEYERIDVSNFEKIKKSNDGSFKVYKNDIVFFIFDEENFKGGKIVSFLEDKTIASFSNPRFPAAIKFQPDSFCIIGKDSNGKPKKSSSKQYKLGKAKGIIKLKIDILGNIESYQVLGNAKSKLLDEIKSIVSH

SEQ ID NO: 10748 - protein, 134 aa, unidentified
  REGION 1..134: note = Description of Unknown:uncultivated organism sequence
KAIKGDKKIEYKRVDASNFQKIKKENDGSFKVYKNDIVFFIFSDATYKGGRVVSFLEDKKIVAFSNPRFAPNAKSQPISFVTIFKGEPYSHKQHSINKAIGIIKINLDILGNIKSYQKFGEVSKEIEAKILHME

SEQ ID NO: 10749 - protein, 135 aa, unidentified
  REGION 1..135: note = Description of Unknown:uncultivated organism sequence
RAIKKGEKLEYERIDVSNFEKMKKSNDGSFKVYKNDIVFFIFDEENYKGGKIVSFLDDKKMAAFSNPKYPANTQSQPESFLTMFQGKPKSHKQVSIGKAKGIIKLKVDILGNIESYQVLGDARSKILDDIKKYSE

SEQ ID NO: 10750 - protein, 147 aa, unidentified
  REGION 1..147: note = Description of Unknown:uncultivated organism sequence
KSWLKDENLHYERIDVANIDTVKKENDSSFKVYKNDLVFFIYPDGSFRGGKIVSFLEENKTGAFQNSKFPMALKYQPSSFCEVDKQGKHTKTKPKSIGKAIGIIKLNLDIVGNIKSYQNIGNVNSECLEFLKENTDGWESSSSHKTL

SEQ ID NO: 10751 - protein, 136 aa, unidentified
  REGION 1..136: note = Description of Unknown:uncultivated organism sequence
RAWLEDDKLHYVRIDVANFKKIQKLNDSSFKVYKNDEIFFIMPDGSRRGGKIVSFLEETKKSAFQNAKYPTSSEYQPMQFCKMDKGKKSGAKQQSIGKAIGIIKLNIDIIGNIKSYQVIGNAESELLDFVKETVHG

SEQ ID NO: 10752 - protein, 141 aa, unidentified
  REGION 1..141: note = Description of Unknown:uncultivated organism sequence
RAWLESDKLQYERIDVANFDTIKKKFDNSFRVFKNDVVFFVYPDGSFRGGKIVSFLDDKGIASFSNPKYPSLSEHQPKSFCKMGKDNNGNPKKSGAKQQNINASIGLIKLSLDIIGNIKSYQVTGNAESELLRFIKDVKNG

SEQ ID NO: 10753 - protein, 133 aa, unidentified
  REGION 1..133: note = Description of Unknown:uncultivated organism sequence
SATLNGDKIEYKRIDVANFETIKKDAGFKVYKNDIVFFIYPDGSFKGGKIVSFLEEKNVASFSNLRYPANINLQPHSFVTLFKGKANSHKQHSINKAIGIIKLHLDIIGNIKSFSSLGEVDSELLSFLKKLKD

SEQ ID NO: 10754 - protein, 136 aa, unidentified
  REGION 1..136: note = Description of Unknown:uncultivated organism sequence
RAYKENEKLEYERIDIANIEKIQKVNDGSFKAYKNDVVLFIFDDKVYKGGKIVSFLEEKKMAAFSNPKYPANIQSQPESFLTMFNGKANSHKQVSISKAKGIIKLYIDILGNIKSYQVLGNAKSKILDEIKSIVSH

SEQ ID NO: 10755 - protein, 137 aa, unidentified
  REGION 1..137: note = Description of Unknown:uncultivated organism sequence
KASLKNDKLFYERIDVANKNNIKDNDFLIIRNNLICINFKNKNLLGFVESFDENTNKIRMYDSRYPKRLENQPERFKVASGKGRKEFGIAGAIGIIKLNLDILGNINSYQIIGTIQNELYSFFKKLKNDKGNLPINT

SEQ ID NO: 10756 - protein, 133 aa, unidentified
  REGION 1..133: note = Description of Unknown:uncultivated organism sequence
KAELENDKLNYKRIDVANRDTMQKEDNNSFSLKVFKNDLVFFIYPEGSFRGGKIVSFLNDKNLGAFQNSRFPTSLKYQPDSYCKDKAHTGAKQHSLNKAIGIIKLNLDILGNIKSYQKTGQCESELLNFIKAV

SEQ ID NO: 10757 - protein, 139 aa, unidentified
  REGION 1..139: note = Description of Unknown:uncultivated organism sequence
RAYKENEKLEYERIDIANIEKIQKVNDGSFKAYKNDVVLFIYNDGSFKGGRVVSYIKKSSGSQLCAFLNPKFPTASEYQPSSFCKIEKGKHSGAKQQSIGSAKGIIKLNLDILGNIKSYQILGNAKSKILDEIKNIVSH

SEQ ID NO: 10758 - protein, 135 aa, unidentified
  REGION 1..135: note = Description of Unknown:uncultivated organism sequence
KSWMKDEKLNYERIDVANFNQIKKEKNNNFKVYKNDIVFFVYPDSSFRGGKIMSLLEESRVASFSNSKYPALVKSQPLSFINISKGKAVNHKQHAISKATGIIKLNLDILGNIKSYQIIGNAKSELLDFIKDTLQ

SEQ ID NO: 10759 - protein, 136 aa, unidentified
  REGION 1..136: note = Description of Unknown:uncultivated organism sequence
KASVENDKLKYERIDVANFQKTKKENDNSFKVFKNDLVFFVYPDGSFKGGKIVSFLEDKKMCAFSNPRFPASIRLQPHSFLTIFKGKANSHKQQSVNKAIGIIKLNLDILGNIKSYKIIGEIQSELFEFIEGIKNG

SEQ ID NO: 10760 - protein, 136 aa, unidentified
  REGION 1..136: note = Description of Unknown:uncultivated organism sequence
KAILENGKFLYERIDVINFAKIQKENDNSFKVFKNDIVFFIYPDGSFRGGKIVSFLEEKSIVAFSNPKFPAKISSQPHSFLTLFNGKANSHKQFTIGKAVGIIKLNLDILGNIKSYQVIGNAKSEFLETIKGIVNG

SEQ ID NO: 10761 - protein, 135 aa, unidentified
  REGION 1..135: note = Description of Unknown:uncultivated organism sequence
KVHLEDEKLVYGRIDAANFDRIKKENDNSFKVYKNDVVFFVYADESFKGGKIVSFLEDKKMAAFSNSRFPASIGLQPHSFLTIFNGKANSHKQQSLNKAVGIIKLNLDITGTIKSFQSIGTINSELLEFIKEAKK

SEQ ID NO: 10762 - protein, 135 aa, unidentified
  REGION 1..135: note = Description of Unknown:uncultivated organism sequence
KAKLKDGKFKYERIDMSNIQRIKKKKDTGFKVYKNDVVFFTYPDGSCKGGRIVSFLDEKNLVAFSNPRFPGSIAYQPEEFLTFFNGKPNSHKQHSIKKAIGIIKLNLDITGNIKSYRTIGSCESEFLEFLKSIKS

SEQ ID NO: 10763 - protein, 137 aa, unidentified
  REGION 1..137: note = Description of Unknown:uncultivated organism sequence
RCSVETPTRLFTDRIDFKDSILLKKNDGSCIDIFNNDLVEICTYEKKQVVLKLTGLLRTFVIDAKENKMLKVKNPKYPIREEAQPKQYNSYVAVKKMCGIKKYKTDASGKVLGFYYLGRVLDNEKELFAKVLSYKAL

SEQ ID NO: 10764 - protein, 139 aa, unidentified
  REGION 1..139: note = Description of Unknown:uncultivated organism sequence
IFEKKDNNKLNITKVDINSLEKLESKNSLIVYLNEIIYIFNNKKIIHYGALRSFSISNQGAKLIKLFNPKFPSNPKAQPAYFSKGSSFKDISIGSATGVIKVKLDISGKIKSYQKYGFISKELEEQFLKESGYGCLENS

SEQ ID NO: 10765 - protein, 140 aa, unidentified
  REGION 1..140: note = Description of Unknown:uncultivated organism sequence
HLSKGPKGKLTIRRVDVNNAHQLSRQKEGMLCYLNEMLFFFNKDKLIHYGCLRSYIESSKKVALFNPRFPANPKTQPKRFTTGSQIKQVSVGSTTGVIKAHLDLDGHVKSYELFGQITPKQLRWFIEESGYGGVENDPDH

SEQ ID NO: 10766 - protein, 142 aa, unidentified
  REGION 1..142: note = Description of Unknown:uncultivated organism sequence
IFAKGEKEKLHIEKVDVNSHKKLQNKDAMIIYLNEMIYLFNKKKIIHYGCLRSFSVKSAGGKYVKLFNPRFPSNPKAQPKKFSTGTSTRDVSVGSVTGVIKVHLDLTGKIKSYEKFGLISKELEERFLEECGYGSMEDDTYH

SEQ ID NO: 10767 - protein, 143 aa, unidentified
  REGION 1..143: note = Description of Unknown:uncultivated organism sequence
HLSKGPKGKLTIRRVDVNNAHQLSRQKEGMLCYLNEMLFFFNNKKLIHYGCLRSFSINNQGAKYLALFNPRYPANPKAQPKRFTTGKKIKPVSVGSTTGVIKAHLDLDGHVKSYELFGQIIPEQLRWFIEESGYGGVENDPDH

SEQ ID NO: 10768 - protein, 149 aa, unidentified
  REGION 1..149: note = Description of Unknown:uncultivated organism sequence
YVTKEKNAIGIFVEKSGKGIDVRRVDVTNKNEFAEKSKKGEGRIFYMNEPLFFFDKKGQIVASGALGGTTTIDKMGIAGKVMLFNPKFPRSPKFQPSHFATGKGSLKEFGIKKAVGVLKITPDLTGRIIKHEKIGIVPSDAMKIVLEGV

SEQ ID NO: 10769 - protein, 143 aa, unidentified
  REGION 1..143: note = Description of Unknown:uncultivated organism sequence
HLSKGPKGKLTIQRVDVNNAHKLKRQREGLFCYLNEMLFFFNEKKLIHSGCLRSFSINNQGSKYVKLFNPKFPSNPKAQPKKFSTGSSTRDVSVGSTTGVIKVHLDMDGHVKSYELFGTVTSEQLRWFIEESGYGGVENDTNH

SEQ ID NO: 10770 - protein, 144 aa, unidentified
  REGION 1..144: note = Description of Unknown:uncultivated organism sequence
FIEKGAKKLQIYRMDVNNFREFSDKKGMVCFLNEMLFFFNSKKLIHYGCLRSFSINNQGAKLVKLFNPKFPSNPKAQPDKFSNGSSIRDVSIGSATGVIKAHLDFDGHVKSYEVFGSVSAEQLAWFRKESGYGSVEDGAHHEAL

SEQ ID NO: 10771 - protein, 142 aa, unidentified
  REGION 1..142: note = Description of Unknown:uncultivated organism sequence
MFERGKKDRLEISKIDLNSMHRLRHSDAMIVYLNEIIYLFNKKKIMHYGALRSFSINKQGGKYIKLFNPRFPGSPKSQPGFFSTGSSIKAVSIGSATGVIKVHLDLDGRVKSYEKYGSIPKELERDFLEESGYGVMEDNTHH

SEQ ID NO: 10772 - protein, 142 aa, unidentified
  REGION 1..142: note = Description of Unknown:uncultivated organism sequence
FVEKGSKKLSFTRVDVNNVKELDRRFDGLKVYLNEMIYIFNDKKLIHYGCLRSFSENNQGTKYVKLFNPRFPSKPKSQPEKFAQPSGIKDVSIGSATGIIKVHLNLNGTVKSYEKFGTIPQKFEKEFLEESGYGGVEDNTHH

SEQ ID NO: 10773 - protein, 130 aa, unidentified
  REGION 1..130: note = Description of Unknown:uncultivated organism sequence
KAKFENEELIYQRIDLANMKNNLKIKGLFIGRNNLIYIVFKKEEKNLIGSLESFDEKNNTIRLFDPRFPKTLEYQPQKYKVTSGKSRKEFSIGSAMGIIKINLDILGNIKSYEKLGVITKELEQKLFHKE

SEQ ID NO: 10774 - protein, 143 aa, unidentified
  REGION 1..143: note = Description of Unknown:uncultivated organism sequence
HLSKGAKGKLTIRRMDVNNVHELSRQKDGMLCYLNEMLFFFKPDKLIHHGCLRSFLENSQGAKLVALFNPKFPATPKSQPKFFAPGSQIKQVSVSSTTGVIKAHLYLDGHVKSYELFGTVTPEQLRWFIEESGYGGMENDTNH

SEQ ID NO: 10775 - protein, 136 aa, unidentified
  REGION 1..136: note = Description of Unknown:uncultivated organism sequence
RCGYIEGESKLSLKRIDIRAYVKNKTAAPNEMDIFNNDLVEVYLLKKRELFKRIVGIVKGFTESKGGRINIRNPKYPLLKEKQPKLYQSEISIGSSCGIKKYKTDASGKVLGFYYLGRVQHEDEELFSKVLAYRRI

SEQ ID NO: 10776 - protein, 142 aa, unidentified
  REGION 1..142: note = Description of Unknown:uncultivated organism sequence
FVTKGSKKLEIVRMDVNNINDLQKEKEGIRVYLNEMIYLFNEKKVLHYGCLRSYLENAQGAKMIALFNSRFPANPKSQPKMFSTGSQIKQVSIGSTTGIVKVHLDINGSVKSYEKFGFIPKELEEEFKLECGYGGVEDDTHY

SEQ ID NO: 10777 - protein, 141 aa, unidentified
  REGION 1..141: note = Description of Unknown:uncultivated organism sequence
HLLIRSGKLQISRLDVNNAYQIKQSEGMRVYLNEMIYLYNDKKLLHYGCLRSYLENAQGAKMIALFNSRYPANPKSQPERFSTGSQIKQVSVGSATGVVKVHLDIDGRIKSYEKYGMIPKEFEEAFRQECGYGGVEDDTDH

SEQ ID NO: 10778 - protein, 140 aa, unidentified
  REGION 1..140: note = Description of Unknown:uncultivated organism sequence
VIRRRENGKLSIVKIDVNNAGKMLTVSEGMIVYLNEMLYLFGERGLLHYGCLRSYVDNRRNIALFNPRFPANPKAQPKKFSTGSQIKQVGVGSAVGVIKPRIDLDGSVKSFQVFGEVTTEQVTWFKKETGYGGVENDTHL

SEQ ID NO: 10779 - protein, 142 aa, unidentified
  REGION 1..142: note = Description of Unknown:uncultivated organism sequence
MFEKGEKEKLIISKIDMNSLHQLKKQNAMIVYPNEVIYLFNKKKIIHYGALRSFLIKSSGARQIALFNPRFPSNPKSQPRNFSDGKSIKSVSIGSTTGIIKVQLDMNGKMKSYQKFGLIPKELEEAFLKESGYGGMEDNTDN

SEQ ID NO: 10780 - protein, 144 aa, unidentified
  REGION 1..144: note = Description of Unknown:uncultivated organism sequence
FIQKGEKKLMISRMDVNNAHELEQNKNGLRVYLNEIIYLYNDKKLLHYGCLRSFVEGNGKIALFNPRFPANPSSQPKFFSTKNEKTTGQIKQIGVGSATGIIKVQLDLNGQMKSYQKFGTIPKELEMQFLKESGYGSMEDDTHH

SEQ ID NO: 10781 - protein, 139 aa, unidentified
  REGION 1..139: note = Description of Unknown:uncultivated organism sequence
FIEKGEKKLKISRMDVNNAYELEQNKNGMRVYLNEMVYFYNEKKSLHYGCLRSYVEGRSNIALFNPRFPANPKVQPSIFSTGSQIKQVSIGSATGIIKAQLNFNGQIKSYQKFGYIPKEFEEVFKKECGYGSMEDDTDH

SEQ ID NO: 10782 - protein, 142 aa, unidentified
  REGION 1..142: note = Description of Unknown:uncultivated organism sequence
MFEKGEKEKLHISKVDVNSLHRLKQENAMIVYLNEVIYLFNKKKIIHYGALRSFSINNQGGKYLKLFNPRYPSNPKAQPKMFTTGSSIKDVSIGSTTGVIKVQLDINGKMKSYQKFGLIPKDLEEEFLKESGYGIVEDNTDH

SEQ ID NO: 10783 - protein, 137 aa, unidentified
  REGION 1..137: note = Description of Unknown:uncultivated organism sequence
RCSVETQTRLFTDRIDFKDSILLKKNDGSYIDIFNNDLVKIFTYEKKQVVLKLTGLLRTFVINAKEDKMLKVKNPKYPIREEAQPKQYNSYVAVKKMCGIKKYKTDASGKILGFYYLGTILDDEKELFAKVLSYKAL

SEQ ID NO: 10784 - protein, 134 aa, unidentified
  REGION 1..134: note = Description of Unknown:uncultivated organism sequence
RCSFDEPKLQLQRIDIRSHVQNRNKNDTQIDIFNNDLIEIYVIKSKKIEYKAIGVLKGFTESKGGRANLRNPKYPLLKDKQPKLFQGEFSIGSTCGIKKYKTDASGRVLGFYYLGRVLEGDKELFSKVVTYRKM

SEQ ID NO: 10785 - protein, 143 aa, unidentified
  REGION 1..143: note = Description of Unknown:uncultivated organism sequence
FISKAENNRVKIERMDVNNAPKLLKRNSGLKVYLNEMIYLFNEKKVIHYGCLRSYVEKTGNSKLVALFNPRFPASPKSQPKMFSTGSQIKQVSVGSATGVIKVHLDLSGQIKSYEKFGMISKELENEFLQECGYGSMEKHPDH

SEQ ID NO: 10786 - protein, 136 aa, unidentified
  REGION 1..136: note = Description of Unknown:uncultivated organism sequence
RCEYADTTKLVLKRIDIRAFASSDQIKAHQIDIYNNDLIEIFIIKSKSIESKVIGILKGFTESKGGRANIRNPKFPALKEKQPKIYQNEISIGSICGIKKYKTDATGKVLGFYYLGRVKEESAELFSPVVAYRKLL

SEQ ID NO: 10787 - protein, 133 aa, unidentified
  REGION 1..133: note = Description of Unknown:uncultivated organism sequence
EVDITDVNLVYKRIDASNIHKVKKENHNSFKVYKNDLVFFIYPDRSFKGGKIVSFLEDKKVGAFSNPRFPANIGFQPHSFLTIFNGKANSHKQVSLNKAIGIIKLNLDILGNIKSYSKIGIIESEFLDFLKNK

SEQ ID NO: 10788 - protein, 140 aa, unidentified
  REGION 1..140: note = Description of Unknown:uncultivated organism sequence
KASLEDEKLHYTRIDVSNFDKIRKENDNSFQVFKNDLVFFIYPDGSFRGGKIVSFLEDKKIASFSNPKFPSASEFQPISFCKIGKDSNNNPKKSGAKQQGINASIGIIKLNLDITGNIKSYQKIGRCESELLEFTKDIKV

SEQ ID NO: 10789 - protein, 137 aa, unidentified
  REGION 1..137: note = Description of Unknown:uncultivated organism sequence
RCKAETENRLFTERIDFKDKILLKKNDGTFIDIYNNDLVDIYTFEKKQVILKLTGLLRTFVINAKEDKMLKVKNPKFPIREDAQPKQYNSYVAVKKMCGIKKYKTDATGKVLGFYYLGRVLDDEKELFTKVLSYKAL

SEQ ID NO: 10790 - protein, 134 aa, unidentified
  REGION 1..134: note = Description of Unknown:uncultivated organism sequence
RAIFENGKLSYKRIDVINFKQMNNKNDGSFKVYKNDSVFFVYLDKTMKGGKIVSFLENKKIAAFSNPKFPSAYKFQPNSFCKDKSHTGAKQHSVGSAIGIIKLNLDILGNIKSYQVLGNAKSEFLETIKGIVNG

SEQ ID NO: 10791 - protein, 134 aa, unidentified
  REGION 1..134: note = Description of Unknown:uncultivated organism sequence
RATFENGELSYRRIDVINFKQMNNKNDGSFKVYKNDLVFFVYLDKTIKGGKIVSFLENKKIAAFSNSKFPSAYKFQPNSFCKDKSHTGAKQHSVGSAIGIIKLNLDILGNIKSYQVIGNAKSEFLETIKGIVNG

SEQ ID NO: 10792 - protein, 124 aa, unidentified
  REGION 1..124: note = Description of Unknown:uncultivated organism sequence
AQAGIEVYYNETKNCFAFVPIPSVCYNLKTRKVNRKHKLYKRYKELNLKDYKVKYIVTLYNGNTIEVLKKDNTIIKGVVSSYHKTNDKIVLKNGSYFTKSDLEFSIIDYNPIGKSQKRLTKRIK

SEQ ID NO: 10793 - protein, 130 aa, unidentified
  REGION 1..130: note = Description of Unknown:uncultivated organism sequence
KQVSTRIFYSYEDKKFIFLPICAISFVNGKLNKKEKNYQTTYNRLIGNKNVKEMGNIYVGEWVGVYKKNGEYFEGRYKGYHKTSNVLEYYINGLDTLSCATIGSSDLRIIIYTTDILGNRHIRLDTQKEI

SEQ ID NO: 10794 - protein, 118 aa, unidentified
  REGION 1..118: note = Description of Unknown:uncultivated organism sequence
KQFCVKVYVDNDNKKFVFLPIYTISLDPKTKKVNENDEFYKLFYNKYIGNKNVTFFADIYNGNKLEITKKDGTIVSGYYSTFNKANNKLILNNGDTFTLSDKKISIIHTDILGNEKKG

SEQ ID NO: 10795 - protein, 123 aa, unidentified
  REGION 1..123: note = Description of Unknown:uncultivated organism sequence
KQFCVKVYVDNDNKKFVFLPIYTISLDPKTKKVNENNEFYKLFYNKYIGNKNVTFFADIYNGNKLEITKKDGTIVSGYYSTFDKSANRLETQNGYIFVCSDKKISIVHTDILGNEKKRLTKEL

SEQ ID NO: 10796 - protein, 124 aa, unidentified
  REGION 1..124: note = Description of Unknown:uncultivated organism sequence
AQAGIEVYYNIDKNNLVFVPIPSIAVNLKNRAINYQHPVLVKYCKKYLNDCNAKRIVTLFNGNTIEVYKSKGNIVKGEVSSFDKNSNRIRLRDGSSFVTSDRGFSVIDYNPIGKSQKRLTFMIK

SEQ ID NO: 10797 - protein, 124 aa, unidentified
  REGION 1..124: note = Description of Unknown:uncultivated organism sequence
AQAGIEIYYNIDKNCFAFVPIPCICYDFKTGKVNKEHPEYIKYFKKNIGNQNIEYKATLYNGNFIEINKKDGKTIKGEVSCYHKTYDRIDLKNGGLFTKSDQGFSIIDYSPTGKAQKRLTFMIK

SEQ ID NO: 10798 - protein, 123 aa, unidentified
  REGION 1..123: note = Description of Unknown:uncultivated organism sequence
KQFCVKVYVDNDNKKFVFLPIYTISLDPKTKKVNENDEFYKLFYNKYIGNKNVTFFADIYNGNKLEITKKDGTIVSGYYSTFHKTHNYLVLNNDKGVMQSDKKISIIHTDILGNEKKRLTKEL

SEQ ID NO: 10799 - protein, 130 aa, unidentified
  REGION 1..130: note = Description of Unknown:uncultivated organism sequence
KQVSTRIFYSYEDKKFIFLPICAISFVNGKLNKKEKNYQTTYNRLIGNKNVKEMGNIYLGEWVGVHKKNGEYFEGRYKGYDKTNNVLEYYINGLDTLSCATIGSSDLRIIIYTTDILGNRHIRLDTQKEI

SEQ ID NO: 10800 - protein, 123 aa, unidentified
  REGION 1..123: note = Description of Unknown:uncultivated organism sequence
KQFCVKVYVDNDNKKFVFLPIYTISLDPKTKKVNENGEFYKLFYNKYIGNKNVTFFADIYNGNKLEITKKDRTIVSGYYSTFNKANNKLILNNGDTFTLSDKKISIIHTDILGNEKKRLTKEL

SEQ ID NO: 10801 - protein, 124 aa, unidentified
  REGION 1..124: note = Description of Unknown:uncultivated organism sequence
AQAGIEVYYNETKNCFAFVPIPSVCYNLKTRKVNREHKLYKRYKELNLKDYKVKYIVTLYNGNTIEVLKKDNTIIKGVVSNYHKTHDNIVLKNGSYFTKSDLEFSIIDYNPIGKSQKRLTKRIK

SEQ ID NO: 10802 - protein, 124 aa, unidentified
  REGION 1..124: note = Description of Unknown:uncultivated organism sequence
AQAGIEVYYVTDKKCFAFVPILCVCFNFKTCKVNKEHPEYIKYFKKNIGNQNIEYKATLYNGNFIEINKKDGKTIKGEVSCYHKTYDRIDLKNGGLFTKSDQGFSIIDYSPTGKAQKRLTFMIK

SEQ ID NO: 10803 - protein, 123 aa, unidentified
  REGION 1..123: note = Description of Unknown:uncultivated organism sequence
KQFCVKVYVDNDNKKFVFLPVYTISLDPKTKKVNENDEFYKLFYNKYIGNKNVTFFADIYNGNKLEITKKDGTIVSGYYSTFDKSSNRLETQNGHKFVCSDKKISIIHTDILGNEKKRLTKEL

SEQ ID NO: 10804 - protein, 130 aa, unidentified
  REGION 1..130: note = Description of Unknown:uncultivated organism sequence
KQVSTSIFYAYEDKKFIFLPICAISFINGKLNEKENNYQTTYNRLIGNKKVTKIGNIYTGEWVGVYKKNGQYLEGRYKGYHKNNNCLEYYINGLDTLSCSTISSSDSRIIIYTTDILGNRYIRLDTDKII

SEQ ID NO: 10805 - protein, 124 aa, unidentified
  REGION 1..124: note = Description of Unknown:uncultivated organism sequence
SQAGIEIYYNIDKNCLAFIPIPAIAVNLKTRVINHNHPMLERYRKKYLKDSNAKRIVTLFNGNTIEIYKAKGGVIKGEVSSFDKDANRIRLKDRSSFVTSDRGFSIIDYNPIGKAQKRLTFMIK

SEQ ID NO: 10806 - protein, 130 aa, unidentified
  REGION 1..130: note = Description of Unknown:uncultivated organism sequence
KQVSTSIFYAYEDKKFIFLPICAISFINGKLNEKENNYQTTYNRLIGNKKVTKIGNIYTGEWVGVYKKNGQYLEGRYKGYHKKNNCLEYYINGLDTLSCSTISSSDSRIIIYTTDILGNRYIRLDTDKII

SEQ ID NO: 10807 - protein, 124 aa, unidentified
  REGION 1..124: note = Description of Unknown:uncultivated organism sequence
AQAGIEVYYNIDKNCFVFVPIPCTCYNFKTGKVNKKNNEYIKYYQKNIGTYNVQYKTTLYNGNTIEINKKDGSIIKGEVSYYHKTLDKIVLKSEQAFTKSDLGFSIIDYSPIGKCQKRLTFMIK

SEQ ID NO: 10808 - protein, 130 aa, unidentified
  REGION 1..130: note = Description of Unknown:uncultivated organism sequence
KQVLTRIFYSYEDKKFIFLPICAISFVNGKLNKKEKNYQTTYNRLIGNKNVKEMGNIYVGEWVGVYKKNGEYFEGRYKGYHKTSNVLEYYINGLDTLSCATIGSSDLRIIIYTTDILGNRHIRLDTQKEI

SEQ ID NO: 10809 - protein, 130 aa, unidentified
  REGION 1..130: note = Description of Unknown:uncultivated organism sequence
KQVSTRIFYSYDDKKFIFLPICAISFVNGKLNKKEKNYQTTYNRLIGNKNVKEIGNIYTGEWVGVYKKNGEYLEGRYKGYHKTSNVLEYYINGLDTLSCVKICSSDLRIIIYTTDILGNRHIRLDTQKEI

SEQ ID NO: 10810 - protein, 124 aa, unidentified
  REGION 1..124: note = Description of Unknown:uncultivated organism sequence
AQAGIEVYYNIDKNCFVFVPIPCTCYNFKTGKVNKENNEYIKYYQKNIGTYNVQYKTTLYNGNTIEINKKDGSIIKGEVSYYHKTLDKIVLKSEQAFTKSDLGFSIIDYSPIGKCQKRLTFMIK

SEQ ID NO: 10811 - protein, 123 aa, unidentified
  REGION 1..123: note = Description of Unknown:uncultivated organism sequence
KQHCVKVYVDNDKKNFVFLPIYIISLDPKTKKINENDEFYKLFYNKYIGNKNVTFFADIYNGNKLEITKKDGTVVNGYYSTFDKTNNKLILNNSSTFTQSDKKVSIIHTDILGNEKKRLTKEL

SEQ ID NO: 10812 - protein, 130 aa, unidentified
  REGION 1..130: note = Description of Unknown:uncultivated organism sequence
KQVSTRIFYSYEDKKFIFLPICAISFVNGKLNKKEKNYQTTYNRLIGNKNVKEMGNIYVGEWVGVYKKNGEYFEGRYKGYHKTNNVLKYYINGLDTLSCATIGSSDLRIIIYTTDILGNRHIRLDTQKEI

SEQ ID NO: 10813 - protein, 124 aa, unidentified
  REGION 1..124: note = Description of Unknown:uncultivated organism sequence
GQYCTKIYWDRNNNEFIFMPIYLTSIDLSTKKINKNSSTYKYYYNTYLKGKNYQFITDVYNGDLIEVEKKDTIIKNYVSCYHKGAHNCIELKNKGSFNVSDKAFKIIDTDYLGNEKIRLTWPKK

SEQ ID NO: 10814 - protein, 124 aa, unidentified
  REGION 1..124: note = Description of Unknown:uncultivated organism sequence
AQAGIEVYYNIDKNTLVFVPIPSIAVNLKNRAINYQHPVLVKYCKKYLNDCNAKRIVTLFNGNTIEVYKSKGNIVKGEVSSFDKNSNRIRLRDGSSFVTSDRGFSVIDYSPIGKSQKRLTFMIK

SEQ ID NO: 10815 - protein, 123 aa, unidentified
  REGION 1..123: note = Description of Unknown:uncultivated organism sequence
KQFCVKVYVDNDNKKFVFLPIYTISLDPKTKKVNENDEFYKLFYNKYIGNKNVTFFADIYNGNKLEITKKDGTIVSGYYSTFNKSANRLETQNGYIFVCSDKKISIIHTDILGNEKKRLTKEL

SEQ ID NO: 10816 - protein, 124 aa, unidentified
  REGION 1..124: note = Description of Unknown:uncultivated organism sequence
AQAGIEVYYNETKNCFAFVPIPSVCYNLKTRKVNREHKLYKRYKELNLKDYKVKYIVTLYNGNTIEVLKKDNTIIKGVVSSYHKTNDKIVLKNGSYFTKSDLEFSIIDYNPIGKSQKRLTKRIK

SEQ ID NO: 10817 - protein, 124 aa, unidentified
  REGION 1..124: note = Description of Unknown:uncultivated organism sequence
AQAGIEVYYNIDKNCFVFVPIPCTCYNFKTGKVNKKNNEYIKYYPKNIGTYNVQYKTTLYNGNTIEINKKDGSIIKGEVSYYHKTLDKIVLKSEQAFTKSDLGFSIIDYSPIGKCQKRLTFMIK

SEQ ID NO: 10818 - protein, 123 aa, unidentified
  REGION 1..123: note = Description of Unknown:uncultivated organism sequence
KQFCVKVYVDNDNKKFVFLPIYTISLDPKTKKVNENDEFYKLFYNKYIGNKNVTFFADIYNGNKLEITKKDGTIVSGYYSTFHKTYNYLVLNNDKGVMQSDKKISIIHTDILGNEKKRLTKEL

SEQ ID NO: 10819 - protein, 123 aa, unidentified
  REGION 1..123: note = Description of Unknown:uncultivated organism sequence
KQFCVKVYVDNDNKKFVFLPVYTISLDPKTKKVNENDEFYKLFYNKYIGNKNVTFFADIYNGNKLEITKKDGTIVSGYYSTFHKTHNYLVLNNDKGVMQSDKKISIIHTDILGNEKKRLTKEL

SEQ ID NO: 10820 - protein, 123 aa, unidentified
  REGION 1..123: note = Description of Unknown:uncultivated organism sequence
KQYCVKIYVDEKDKKFVFLPIYTISLNPKTKLINENDNYYKLFYDKYIKDKNVSFFADIYNGNKLEITKKDGTVITDYYSCFHKTHNMLVLNDGGSFTTNDKKISIIHTDILGNEKKRLTKEL

SEQ ID NO: 10821 - protein, 123 aa, unidentified
  REGION 1..123: note = Description of Unknown:uncultivated organism sequence
KQFCVKVYVDNDNKKFVFLPIYTISLDPKTKKVNENDEFYKLFYNKYIGNKNVTFFSDIYNGNKLEITKKDGTIVSGYYSTFDKSSNRLETQNGHKFVCSDKKISIVHTDILGNEKKRLTKEL

SEQ ID NO: 10822 - protein, 130 aa, unidentified
  REGION 1..130: note = Description of Unknown:uncultivated organism sequence
KQVSTRIFYSYDDKKFIFLPICAISFVNGKLNKKEKNYQTTYNRLIGNKNVKEIGNIYTGEWVGVYKKNGEYFEGRYKGYHKTSNVLEYYINGLDTLSCAKICSSDLRIIIYTTDILGNRHIRLDTQKEI

SEQ ID NO: 10823 - protein, 123 aa, unidentified
  REGION 1..123: note = Description of Unknown:uncultivated organism sequence
SIYCTRLYWDKDKKKILFMPIYAPVVNPVTGKINEQHPLYKLYYEQCIEGKNVQFIVDLFNGNYVEIEKSDGTTIKEYIKGYAKASSSIQCKSGKYLSPKDKFTLYDVDVLGNKIKRLTWPQD

SEQ ID NO: 10824 - protein, 135 aa, unidentified
  REGION 1..135: note = Description of Unknown:uncultivated organism sequence
AIYCTKLYWDKDEKKILFFPIYLPVLKFDKKKGNDQHPKINDQHPLYQLYYNKLLKGKRVEHIVDLYNGNFIKIEKNKKAPTFEYVSTFDKNSGNVRCKLLNGKNGSRISSKDKFTLYDVDILGNKKKRLTWPKE

SEQ ID NO: 10825 - protein, 124 aa, unidentified
  REGION 1..124: note = Description of Unknown:uncultivated organism sequence
KQYCTEIYYDIDHNKFAFLPVYSVSVDLNHKKINREDSYYKKMREVYLKDSTVEYITTIFNGNYISVIKKNGFIINGFYRYFHRTNNKLLLKNDEALTSSDKSFTIYDVDVLGNKKERLTYSIK

SEQ ID NO: 10826 - protein, 130 aa, unidentified
  REGION 1..130: note = Description of Unknown:uncultivated organism sequence
SQVSTQILYGIEDKKFIFLPIPSICYQNGRLNTNHPYYIETYNRLVGSQKAIEFASIYCGEWVGVIKRNGEYKEGRYSTYNKNNNNLILDTNGLKSVSETYITANDQAIIIYTTDILGNRYVRLDSRKIL

SEQ ID NO: 10827 - protein, 123 aa, unidentified
  REGION 1..123: note = Description of Unknown:uncultivated organism sequence
AQTCTQVFYNKSKNCFAFLPIYSISVDLNTRKIIKNDYYKQMYNEYIKEDEVKHIVDLYNGNYIEVTKKDGTIIKGEYKCFHKTNAVVTLKNDLYFTKQDKKLVVKDKDVIGNEKERLTFEIK

SEQ ID NO: 10828 - protein, 133 aa, unidentified
  REGION 1..133: note = Description of Unknown:uncultivated organism sequence
SQYCTEIYYNYETQKFIFLPIFMVSVDVNSKKINRDEHYFKETYERLIGNKKPKYIATLYNGSWCEITKKNNQTAEGRYIGYHKTNNLLTFGKDGEYSSSAPLYMSPNDKRIIIYGFNILGKKYKILDSNDII

SEQ ID NO: 10829 - protein, 147 aa, unidentified
  REGION 1..147: note = Description of Unknown:uncultivated organism sequence
EIFEIRDDDTRYPKLRGRWQVEILSNYNAQLNAGAPLWRHKYATAKRIMSLRINDMVMAEFSKDDPKLPKGLVETVAHQCAIEKTDKVNVVFRVKKLNSSGTVYLRPHFIAKEDADTKSWIASATSLQEHKARKVCVSPSGKILGLK

SEQ ID NO: 10830 - protein, 200 aa, unidentified
  REGION 1..200: note = Description of Unknown:uncultivated organism sequence
DVYQISPRDKVYTDKKEQGSWKVEVLSNYMATLNKGQALWRKKHPTARLVMRLKIDDMVMGENFTKEEAEQKLQQEIEKWEKSKEMKKYKDKLTEWEKTHEGKEPKKPEKPKSINEIIIEKCNKEKTSSTSFLFRVKKISSDGSVYIRPDFITKEESDKKSVKLSASSYQKYKIRKVFVSPAGKLVDNGFSDKWNDTKCN

SEQ ID NO: 10831 - protein, 157 aa, unidentified
  REGION 1..157: note = Description of Unknown:uncultivated organism sequence
EVYQINPQNKIEGVSTNNQGEWRTEIVSNYNATIRQKRGEDIGYWRYKYPNAKRIMSLRRNDMVLATFSKEQAFSDDFPKGISSYVREKFEHNPSLEYIDILFRVKKMSESSIFFTPHDIAKEDADPKSWKASAEKMKLYNTRKVFVTPMGRICHAK

SEQ ID NO: 10832 - protein, 157 aa, unidentified
  REGION 1..157: note = Description of Unknown:uncultivated organism sequence
DIYCLRPDDKKYPKDAGKWKGEVISNFSVHQPDFQPQWRKIHPTAKRVMRLFINDTVCLTFNRNEPEDEIPMGLKSFVSDAFAKNTGKEINMLFRVKKMSGSRVYLRPSFVSKEEGDKLSWGPSAQGLFERKARKVYVNEIGEYKDPGFVDVWEKKK

SEQ ID NO: 10833 - protein, 163 aa, unidentified
  REGION 1..163: note = Description of Unknown:uncultivated organism sequence
DIICLRPDDKREPEKAGKWKGEVISNYNAHKPNFEPKWRKEHPTAKRIMRLFINDMIVLTFNKKDKNDFPKNIKNFILEEFNKTKKNEVDMVFRIKKISTNGTFFITPHFIVKDEKDKFSWGASVSGIFIYKARKVYVDELGKIIDNGFIQGWEKNVKCVRNK

SEQ ID NO: 10834 - protein, 147 aa, unidentified
  REGION 1..147: note = Description of Unknown:uncultivated organism sequence
DVFKMRDDDKRYPKLRGRWQVEILSNYNAQLDAGSPLWRRKYATAGRVMRLRINDMVMATFSKDDPKLPKGLVETVMHQCAIENTDTVNVIFRVKKISSNGTIYLRPHFIAKEEGDTKSWIASATSLQEHNAHKVYVSPSGKLQCLE

SEQ ID NO: 10835 - protein, 147 aa, unidentified
  REGION 1..147: note = Description of Unknown:uncultivated organism sequence
DVFKMRDDDKRYPKLRGRWQVEILSNYNAQLDAGSPLWRRKYATAGRVMRLRINDMVMATFSKADPKLPKGLVETVMHQCAIENTDTVNVIFRVKKISSNGTIYLRPHFIAKEEGDTKSWAASATSLQEHNAHKVYVSPSGKLQCSE

SEQ ID NO: 10836 - protein, 147 aa, unidentified
  REGION 1..147: note = Description of Unknown:uncultivated organism sequence
DVFKMRDDDKRYPKLRGRWQVEILSNYNAQLDAGSPLWRRKYATAGRVMRLRINDMVMATFSKDDPKLPKGLVETVMHQCAIENTDTVNVIFRVKKISSNGTIYLRPHFIAKEEGDTKSWAASAASLQEHNARKVYVSPSGKLQYSE

SEQ ID NO: 10837 - protein, 145 aa, unidentified
  REGION 1..145: note = Description of Unknown:uncultivated organism sequence
DIFEIRSDDKHYPKDAGKWKVDIVSNYMAETNPGVSLWHKKYPTARRIMSLRINDMVMAEFSKDDPQLPNGIRDTVAHQCAVENKDTVNMVFRVKKLNSSGTIYLRPHFIAKEDADTKSWIASTTSLKEHKARKISVSPTGKILK

SEQ ID NO: 10838 - protein, 157 aa, unidentified
  REGION 1..157: note = Description of Unknown:uncultivated organism sequence
EIYQIHPENRICGIPTNNRGEWKMEVVSNYNATVRQSRGENIGYWYYKYPNAKKIMRLRRNDMVMATFTKEQAFADKFPKGICEYVRGKFEQNQLLAQVDILFRVKKMVSGVITFTPHDIAKEQADTKSWSASSGAMQTYRTRKVKVTPMGRICHVK

SEQ ID NO: 10839 - protein, 156 aa, unidentified
  REGION 1..156: note = Description of Unknown:uncultivated organism sequence
EIYEINPNNKIEGVASKDRGEWKTEIVSNYNATVRNSRGEDIAYWRYKYPNAKRIMSLRGNDMVMATFSREQAFDEKFPKGIQEYVREKFQQKSDCQELDILFRVKKMGSNGICFTPHNIAKENADTKSWIASAGAMQKYRVRKIHISYMGRIQNA

SEQ ID NO: 10840 - protein, 147 aa, unidentified
  REGION 1..147: note = Description of Unknown:uncultivated organism sequence
DVFKMRDDDKRYPKLRGRWQVEILSNYNAQLDAGSPLWRRKYATAGRVMRLRINDMVMATFSKDDPKLPKGLVETVMHQCAIENTDTVNVIFRVKKISSNGTIYLRPHFIAKEEGDTKSWAASATSLQEHNAHKVYVSPSGKLQCSE

SEQ ID NO: 10841 - protein, 157 aa, unidentified
  REGION 1..157: note = Description of Unknown:uncultivated organism sequence
EIYEINPQNKICGVTTKDCGEWKSEIVSNYNATIRNNRGEDIAYWRYKYPNAKRIMSLRGNDMVMATFSREQAFDENFPKGIQEYVREKFQQKPDCKELDILFRVKKLTNNGQIFITPHNIAKENADTKSWGASASAMQKYKMRKVHISYMGRIQNA

SEQ ID NO: 10842 - protein, 112 aa, unidentified
  REGION 1..112: note = Description of Unknown:uncultivated organism sequence
DIFKKKGQYYFVPIYSWNKSLPNRACQGKNKSDWVVVDDSYEWCFSVRTNDLLKIVIKGKTYFDYYITLDVHSDGRIRLLNHDRQEDDVHYEKGEFRILIKNADSINIMLMF

SEQ ID NO: 10843 - protein, 128 aa, unidentified
  REGION 1..128: note = Description of Unknown:uncultivated organism sequence
DIFFKEGKYYLVPIYAIAKELPNRACVAKKHESEWTVIDDTYQWCFSVTQYDLIKIELKKETYFGYFNGFDRATGAVNIILHDRSTEKYKKGLIRSIGLKTAKSVTKYRVDVLGNYYLAGAEKRLELA

SEQ ID NO: 10844 - protein, 129 aa, unidentified
  REGION 1..129: note = Description of Unknown:uncultivated organism sequence
DIFKKKSQYYFVPIYSWNKSLPNRACQGKNKSDWVVVDDSYEWCFSVRTNDLLKIVIKGKTYFDYYITLDVHSDGRIRLLNHDRQEDDVHYEKGEFRILIKNADSINKYNVDVLGNYYLAKPEKRLELA

SEQ ID NO: 10845 - protein, 129 aa, unidentified
  REGION 1..129: note = Description of Unknown:uncultivated organism sequence
DIFKKKGQYYFVPIYSWNKSLPNRACQGKNKSDWVVVDDSYEWCFSVRTNDLLKIVIKGKTYFDYYITLDVHSDGRIRLLNHDRQEDDVHYENGEFRILIKNADSINKYNVDVLGNYYLAKPEKRLELA

SEQ ID NO: 10846 - protein, 128 aa, unidentified
  REGION 1..128: note = Description of Unknown:uncultivated organism sequence
DLFKKDGKYYCIPVYAWNKTLPNRAYVSGKKETDWALVDDSFEWCFSIRQNELLKIKLKGETIFGYYNGFDRDRGSFNILLHDRQDGKDHKQGLIRKGIKTAISITKYDVDVLGNYYLSKPEKRLELA

SEQ ID NO: 10847 - protein, 129 aa, unidentified
  REGION 1..129: note = Description of Unknown:uncultivated organism sequence
DIFKKKGQYYFVPIYSWNKSLPNRACQGKNKSDWVVVDDSYEWCFSVRTNDLLKIVIKGKTYFDYYITLDVHSDGRIRLLNHDRQEDDVHYEKGEFRILIKNADSINKYNVDVLGNYYLAKPEKRLELA

SEQ ID NO: 10848 - protein, 129 aa, unidentified
  REGION 1..129: note = Description of Unknown:uncultivated organism sequence
DIFKKKGQYYFVPIYSWNKSLPNRACQGKNKSDWVVVDDSYEWCFSVRTNDLLKIVIKGKTYFDYFITLDVHSDGRIRLLNHDRQEDDVHYENGEYRISLKNADSINKYNVDVLGNYYLAKPEKRLELA

SEQ ID NO: 10849 - protein, 129 aa, unidentified
  REGION 1..129: note = Description of Unknown:uncultivated organism sequence
DIFKKRGKYYCIPIYAWNKTLPNKACVARKNESDWVEIDDSYEWCFSVRTNDLIRIDGKKESFFGYFNGFHRSVASFSILFHDRQISKKYKKGEKEGIGVKTAYSLTKYNVDVLGYYYLAKPEKRLELA

SEQ ID NO: 10850 - protein, 8 aa, unidentified
  REGION 1..8: note = Description of Unknown:uncultivated organism sequence
PFIVKLQK

SEQ ID NO: 10851 - protein, 129 aa, unidentified
  REGION 1..129: note = Description of Unknown:uncultivated organism sequence
DIFKKKGQYYFVPIYSWNKSLPNRACQGKNKSDWVVVDDSYEWCFSVRTNDLLKIVIKGKTYFDYYITLDVHSDGRIRLLNHDRQEDDVHYEKGEFRILIKNADSINKYNVDVLGNYYLAKPEKRLGLA

SEQ ID NO: 10852 - protein, 128 aa, unidentified
  REGION 1..128: note = Description of Unknown:uncultivated organism sequence
DLFKKDGKYYCIPVYAWNKTLPNRAYVSGKKETDWALVDDSFEWCFSIRQNELLKIKLKGETIFGYYNGFDRDRGSFNILLHDRQDGKDHKQGLIRKRIKTAISITKYDVDVLGNYYLSKPEKRLELA

SEQ ID NO: 10853 - protein, 124 aa, unidentified
  REGION 1..124: note = Description of Unknown:uncultivated organism sequence
DFFKKNEKYYAIPVYSWQQELPNKIAVKGKRECDWLTLDASYKFCFSVYKNDFLEISTKGKIIRGYYAEFDRHRCSILIKSHDRNELLEQRVAYMQVDYIKKLNVDLLGNVYDSFKEENTRERI

SEQ ID NO: 10854 - protein, 129 aa, unidentified
  REGION 1..129: note = Description of Unknown:uncultivated organism sequence
DIFKKSNKYYCVPIYSINKELPNLACVANKNESNWDVIDSSFEWCFSIRQNELIRIEQKNNFYFGYFNSFDRGNGTFSILLHDREDSKDHKKGEIRGIGVKTALSLTKYYVDVLGNYYKAQPEKRLELA

SEQ ID NO: 10855 - protein, 125 aa, unidentified
  REGION 1..125: note = Description of Unknown:uncultivated organism sequence
DIFRKDGKYYMVPVYYKDLYLHRMPTKAVVAHKETADWEKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 10856 - protein, 125 aa, unidentified
  REGION 1..125: note = Description of Unknown:uncultivated organism sequence
DIFRKDGKYYMVPVYYKDLYLHRMPTKAVVAHKETADWKKMDDKDFLFSLYPDDLIKVQKKNKEIENGYYETSDRYSAGISYVQHDLGAKSYVRLCIQNLAIFEKLNVDILGNIYSCSKEEREWL

SEQ ID NO: 10857 - protein, 125 aa, unidentified
  REGION 1..125: note = Description of Unknown:uncultivated organism sequence
DIFRKDGKYYMIPVYYKDLYLHRMPTKAVVAHKETADWKKMDDKDFLFSLYPEDLIKVQKKNKEIENGYYKTSDRYSAGISYVQHDLGAKTYVRLCIQNLAIFEKLNVDILGNIYSCSKEERERL

SEQ ID NO: 10858 - protein, 125 aa, unidentified
  REGION 1..125: note = Description of Unknown:uncultivated organism sequence
DIFRKDGKYYMIPVYYKDLYLHRMPTKAVVAHKETADWKKMDDKDFLFSLYPDDLIKVQKKNKEIENGYYKTSDRYSAGISYVQHDLGAKTYVRLCIQNLAIFEKLNVDILGNIYSCSKEEREWL

SEQ ID NO: 10859 - protein, 125 aa, unidentified
  REGION 1..125: note = Description of Unknown:uncultivated organism sequence
DIFRKDGKYYMIPVYYKDLYLHRMPTKAVVAHKETADWKKMDDKDFLFSLYPDDLIKVQKKNKEIENGYYKTSDRYSAGISYVRHDLGAKSYVRLCIQNLAIFEKLNVDILGNIYSCSKEEREWL

SEQ ID NO: 10860 - protein, 119 aa, unidentified
  REGION 1..119: note = Description of Unknown:uncultivated organism sequence
DIFRKNGKYYMIPVYFRDLYAGTLPMRAVRAKEKEVDEKDYIFSLYPDDLIKISKNGREYYGYYKTCDRTNAAIKYKSHDSSSSEYIVTGIQKLDLFEKKSIDILGNIYKRNKEEREWN

SEQ ID NO: 10861 - protein, 149 aa, unidentified
  REGION 1..149: note = Description of Unknown:uncultivated organism sequence
QIYQIQKNDKFAPNKNEDWSLEILPNYYAFERKGKFFWKDIYPTAKLITTLKINDVIEATFERNDNLESGFSKIRNWVKEQFENHPDKEQLQLLFRVKKMSGGSIFLRPLHIAQEDNGDVKSWQCTIGKFKQYQCRKVCITPTGKVLRG

SEQ ID NO: 10862 - protein, 149 aa, unidentified
  REGION 1..149: note = Description of Unknown:uncultivated organism sequence
QIYQINKNDKFVPNRNENWSVEILSNYYAFERKGRFFWKDIYPTAKLIATLRINDIVEATFDKEDQLDKGFTQNKKWVNHQFELNPNVQQLQLLFRVKKMTGGSIYLRPLHVAQEDADKKSWICSVGKFKDYHCHKVCVTATGKVLNGN

SEQ ID NO: 10863 - protein, 149 aa, unidentified
  REGION 1..149: note = Description of Unknown:uncultivated organism sequence
QIYQINKNDKFVPNRNENWSVEILSNYYAFERKGRFFWKDIYPTAKLITTLRINDIVEATFDKEDQLDKGFTQNKKWVNHQFELNPNVQQLQLLFRVKKMTGGSIYLRPLHVAQEDADKKSWICSVGKFKDYHCHKVAVTATGKVLNGN

SEQ ID NO: 10864 - protein, 137 aa, unidentified
  REGION 1..137: note = Description of Unknown:uncultivated organism sequence
GIYENPVSKERKFKVIKFFDAVRLKAASKPVLPNSLDDFRLIYTLKKGEMFVMVEEHEDEILNMDKKALFKNLYKVIKFSQGKIYLGLHCVAKLGDDDESNDKEQENDRVKVRIYRNALKFRAVKVKIDILGRISIA

SEQ ID NO: 10865 - protein, 151 aa, unidentified
  REGION 1..151: note = Description of Unknown:uncultivated organism sequence
ALYESKEVDKKGKEKIKRDFEIVSFFKAVERRRKGEKLFPDEKEQKDGTFLPLMKSCPYLKAGDFVVMYENEASEIDWDVKEDLMKRLYKVTELGLNPTGDGYAVIKLVKHNLMKTVKDSYLKNGPFLKRSESINAIKVIIDRLGNIKPAI

SEQ ID NO: 10866 - protein, 132 aa, unidentified
  REGION 1..132: note = Description of Unknown:uncultivated organism sequence
AIYEDRRGKRDFRTINFLEASKRALHKQPIYPSELDGKQLLMTLQQKDLVILYDEHQDEIQWHDPNWLANHLYMVKSFDRIGAIRMVLHKRSNANPNFPKLYPAGTTYTKKVSSFRGVPVAVDALGQITKVQ

SEQ ID NO: 10867 - protein, 219 aa, unidentified
  REGION 1..219: note = Description of Unknown:uncultivated organism sequence
GVYQEGKDFEIEKVFFFDAVQRKLKKEPLLPAQKEKEKRLSTLKKGDKLFWGKELLKLSLKNSKELAKLLDIFRHTDLPFWFQEAQSEKQFLVKEINEKGVLYIKTLPLVQTFKKGDMVYRFGKTTAESTVQKPEDINWNDQEAISDRLYRVQKITDGSIYITKHYIAKFPQGKEAWERKINNDANKKFALRLQCGYGSLDMIAVEIDILGNIKVKKAK

SEQ ID NO: 10868 - protein, 146 aa, unidentified
  REGION 1..146: note = Description of Unknown:uncultivated organism sequence
GVYEAEVINKGKPQTKRMDIVVSFMESIQRKTNNLPVLQPIIQEGEQTYKLIYTLKKGDMFVMYENHTDEISWHDDKDLFKRLYKVIEISSGTIYFGLHYAAKTSADRSKDKNEKKEQSIVRIFRSPSKLKAVKVKIDILGRISMA

SEQ ID NO: 10869 - protein, 159 aa, unidentified
  REGION 1..159: note = Description of Unknown:uncultivated organism sequence
ALYESKEVDKKGKVKIKRDFEIVSFFKAVERSRNGEKLFADEKEQKDGTFLPLMKSCPHLKAGDFVVMYENEPEEINWESKKDLMKRIYKVTQLSSKIVSKIYEFGDLFFTKHNISSSNAKYESKGYSNIKEYKYLQNSHIQLKAIKVQIDRLGNISKA

SEQ ID NO: 10870 - protein, 143 aa, unidentified
  REGION 1..143: note = Description of Unknown:uncultivated organism sequence
GIYQDPRSGEKEVYIASFYEAVQRKIKKLPVLEPMLGNKKLVLTARQGDMFVIYENHPDEIEKHINWDCIDHQARRFLFDRLYRVRKMDKSSGRLYLAQHHLAKVDLDRDPFPLKIYPNGKNFNGIPVEIDILGNIKRKKAYN

SEQ ID NO: 10871 - protein, 174 aa, unidentified
  REGION 1..174: note = Description of Unknown:uncultivated organism sequence
KLFAIPGDNYLMAIYQQDTDKPNSKRDFELVNFFDAVAISKKSSEKKYGKLDLYTPISQKNNFPLYQVIKKGDMVLLYESSAEEEIKWDDNEDLFMRLYQITGLNISPNNYGRIYLMKHNDARKSSDLGTPITGAFKFGDNKIKRMLYHTQFNALIEGKDFKISTTGKITKIGK

SEQ ID NO: 10872 - protein, 130 aa, unidentified
  REGION 1..130: note = Description of Unknown:uncultivated organism sequence
EIYADEDGTQKGEVVTLFEAYRRKREGEPIIKTNHGPNKEFVCSLQINEAVLWGEVPEAFDPEDKATYGAVFDKVFRVQKSSKAQMNFRTHNTAITNDYDRRCLLQKSPSKFFGTKILISPAGFIEYADD

SEQ ID NO: 10873 - protein, 132 aa, unidentified
  REGION 1..132: note = Description of Unknown:uncultivated organism sequence
AIYQDPETKKRSFETISFYSAVQRSLQNEPIVKETFDGRPLLYALKQRDIVVRYDEGPDEIDWSDMEYLRKRLFRVRKFDVKGIVYLDYLYASKLNDKEDRNTLFFQLSPNTLNCVHIELDALGNIIRKEGV

SEQ ID NO: 10874 - protein, 240 aa, unidentified
  REGION 1..240: note = Description of Unknown:uncultivated organism sequence
ALYESKETDKKGKVKIKRDFEIVSFFKSVERRRIGEKLYADEKEQKDGTFLPLMKSCPFLKAGDFVVMYENEESEINWDAKKDLMQKLYFIAELNRQVNVDKQTGKENEFGVIKLNKHNNQKTTNNSYITEGPFIKILHTGLKVVKVNIDSLGNITPIKTQNPYLFSKEENNNNTISESETNYQKKTIQSFSSLKESNEANAKQMAAIPPIDHLKNVITLVKQVYKEELKEPMDKKLNFE

SEQ ID NO: 10875 - protein, 170 aa, unidentified
  REGION 1..170: note = Description of Unknown:uncultivated organism sequence
VFYRNSSGKKKFAQPISFFESVKRKQKCEKLIPDEIEYKDEIYGLDKSLPWIKIGDIVFLYKKGENIDEINWEDKNLLSKRLFKIKSISSSEVKSNKKVYEYGYIYLLNIKRAKDSGYKSQNNIEKAIKLPSFKLSHDKFDAIKVRLNSLGEIIAKGEECFIKNEYLIDE

SEQ ID NO: 10876 - protein, 152 aa, unidentified
  REGION 1..152: note = Description of Unknown:uncultivated organism sequence
ALYEKKQFDAKGRKKKSLREFEIVSLFESVRRKSEGKRLFSDEKNGIGLMESCPYLIIGDMVVMYEEDESEINWEDLDSLQKRLYRVSGMSSEEKYGILSFVKHDKTSQNASYGKAAYKYGSNQISFASRHTQLNIVKVSITQLGKIERLHG

SEQ ID NO: 10877 - protein, 132 aa, unidentified
  REGION 1..132: note = Description of Unknown:uncultivated organism sequence
VIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNESGEIRPA

SEQ ID NO: 10878 - protein, 132 aa, unidentified
  REGION 1..132: note = Description of Unknown:uncultivated organism sequence
VIFSKPDGKKDGIVVSLFEVAQRKRNKQPIYQTDVGEENTFLMTLQINELVLLNGEHFEAAEINWNNVSNEELSPYLYRVQKLTSGGVTFRHHLTSVLKNDSNVEIGRAIKTPNSFNGIKVTVNELGEIRPA

SEQ ID NO: 10879 - protein, 132 aa, unidentified
  REGION 1..132: note = Description of Unknown:uncultivated organism sequence
VIFSKPDGKKDGIVVSLFEVAQRKRNKQPIYQTDVGEENTFLMTLQINELVLLNGGHFEAAEINWNNVSNEELSPYLYRVQKLTSGGVTFRHHLTSVLKNDSNVEIGRAIKTPNSFNGIKVTVNELGEIRPA

SEQ ID NO: 10880 - protein, 132 aa, unidentified
  REGION 1..132: note = Description of Unknown:uncultivated organism sequence
VIFSKPDGKKDGIVVSLFEVAQRKRNKQPIYQTDVGEENTFLMTLQINELVLLNGEHFEAAEINWNNVSNEELSPYLYRIQMLTDGKVTFRHHLTSVLKNDSNVEIGRAIKTPNSFNGIKVTVNELGEIRPA

SEQ ID NO: 10881 - protein, 130 aa, unidentified
  REGION 1..130: note = Description of Unknown:uncultivated organism sequence
AIYEDPETKKRAFETISFYTAVKRSLNNKPIINSNLDNKPLLFALKQRDIVIRYDSGPDEIDWEDMKYLRSRLFRVRKFDVVGQIFIDYLYASKINKEDRNTLFFQLRINTANIIKVEVDLLGRILNKMD

SEQ ID NO: 10882 - protein, 132 aa, unidentified
  REGION 1..132: note = Description of Unknown:uncultivated organism sequence
AIYEDAKGKRAFRTVSFFDAVQRAKRKEPLYPAEVEGKKHLMTLQQRDLVVLYDKHPDQIQWNSPNWMAEHVYSIRSLDRKGEVHMVLHKAGNASSGNAAQKAAAIYLRRKVGGLTVVPITVDPLGTLVRRK

SEQ ID NO: 10883 - protein, 133 aa, unidentified
  REGION 1..133: note = Description of Unknown:uncultivated organism sequence
AIYEDVNGKRDYESVSFYDAINKVISGKLVYPKSKQNKNLKYTVKILDKFIIYSESPEEINWTDFTSLNSRLYHLKKFTGSTVYISKSTIANEDSKVYKMPASKQSSVNTFSAIKIKLNLLGQIIWRSDIGKV

SEQ ID NO: 10884 - protein, 102 aa, unidentified
  REGION 1..102: note = Description of Unknown:uncultivated organism sequence
IIYEGEGGKRDYLSLSFYNAINNKKELGQLYPNILENKNLKFSLTHYDKFILYSAHQEEIDWSNKEELFNKLYHVLSFTGNSLYLGKSNLSNIKSNIVLTPN

SEQ ID NO: 10885 - protein, 55 aa, unidentified
  REGION 1..55: note = Description of Unknown:uncultivated organism sequence
DFDFSTYQEIMTKFFKLQKGKEIKKDTFFLCHLLDKMLILESGGEIKLLLSVIKK

SEQ ID NO: 10886 - protein, 214 aa, unidentified
  REGION 1..214: note = Description of Unknown:uncultivated organism sequence
TFDFNTYQEIMTKFFKLQKRKRNKKRHIFSLPSLGQNAKFRIKRGDQIAIVGSENIATKTFLVDGKLVQVPFFSKNVIPLKIADLLNAIKLNENAKAIYQVDINIDQIKEYVNKLVYTLTEASRLTVKVTLLKSAFDVDFDQIKQFNGAQDDEFRSFLQKYIQNKESILYSYLGSIRDTLNGKALLLDNSQHTITLQYKADINSYKKEIILNNI

SEQ ID NO: 10887 - protein, 214 aa, unidentified
  REGION 1..214: note = Description of Unknown:uncultivated organism sequence
QFDYNKYYEKMAKFFKLNQRKRGKKRHLFSLPSLGQNAKFRIKRDEQIDIVGIKNIATKTYLINNKLVTIPFFSKNVIPLKISDLLNIIKLNKNVKSIFEIKIDTNEVKEYIQKLTYKLTEASRLTLEVTLVKNRFDIDFNKIKEFNGEKDKEFQNFLKEYIQNKNSAVYPYIGSIRDSLKGKAILINNNKDTITLKYKADTNSDKKNIILKNI

SEQ ID NO: 10888 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKENEVCSITKKDTVKKFEIDILGKKLGEVKKYGEPLSLLPEKN

SEQ ID NO: 10889 - protein, 139 aa, unidentified
  REGION 1..139: note = Description of Unknown:uncultivated organism sequence
SRLDDRQYYCLEVYRCKDGTTGLRGIKYSWLKKKNGKLLISANYPENYASHECYLFKGDYVCIQKKKKDGYEAKYEGYYQSIKSINQGYLWFTDRIKTQNRVISIAKNDRFVKRDVSLLGDLGGMVSCGKPFLSEATRS

SEQ ID NO: 10890 - protein, 144 aa, unidentified
  REGION 1..144: note = Description of Unknown:uncultivated organism sequence
AYMDDRSYYCVDVYKNHKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIYKCGEPLSYLPEKD

SEQ ID NO: 10891 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPLSLLPEKN

SEQ ID NO: 10892 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNIICCGYYFSLKDSSRNELYISKGNTRRKLNNMKEKEACSITKKDTVKKFEIDILGKKLGEVKKYGKPLSLLPEKN

SEQ ID NO: 10893 - protein, 142 aa, unidentified
  REGION 1..142: note = Description of Unknown:uncultivated organism sequence
AVLDNSYYYCVEVYRTRSGNIDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLTKCGEPLSLLPEKN

SEQ ID NO: 10894 - protein, 142 aa, unidentified
  REGION 1..142: note = Description of Unknown:uncultivated organism sequence
ALLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 10895 - protein, 142 aa, unidentified
  REGION 1..142: note = Description of Unknown:uncultivated organism sequence
AVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTKAFREESTTISADAEIEKIYVDILGKKGKVLTKHGEPLSLLPEKN

SEQ ID NO: 10896 - protein, 142 aa, unidentified
  REGION 1..142: note = Description of Unknown:uncultivated organism sequence
TVLNDSRFYCVEVYRTRSGNIDLQGIKYTDLVNKNKKLYLKPCYKYPENYYKYIMYLFKGDYLRIKGPKSIRLGFYKAVNYINQNSIKITRYNSKYTKAFREESTTINADAEIEKIYVDILGKKGKVLTKHGEPLSLLPEKN

SEQ ID NO: 10897 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEACSITKKDTVKKFEIDILGKKLGEVKKYGEPLSLLPEKN

SEQ ID NO: 10898 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNKICCGYYFSLKDSSKNELYISKGNTRRKLNNMKEKEACSITKKDTVKKFEIDILGKKLGEVKKYGEPLSLLPEKN

SEQ ID NO: 10899 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKCGEPLSLLPEKN

SEQ ID NO: 10900 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGKVKKYGKPLSLLPEKN

SEQ ID NO: 10901 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEVCSITKKDTVKKFEIDILGKKLGEVKKCGEPLSLLPEKN

SEQ ID NO: 10902 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKSSSRNELYMSKGNTRRKLNNMKENEVCSITKKDTVKKFEIDILGKKLGEVKKYGEPLSLLPEKN

SEQ ID NO: 10903 - protein, 144 aa, unidentified
  REGION 1..144: note = Description of Unknown:uncultivated organism sequence
TVLNDSRFYCVDVYRTCNDETNLNFIKYTDLLKKNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 10904 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKSSSRNELYMSKGNTRRKLNNMKENEVCSITKKDTVKKFEIDILGKKLGEVKKCGEPLSLLPEKN

SEQ ID NO: 10905 - protein, 144 aa, unidentified
  REGION 1..144: note = Description of Unknown:uncultivated organism sequence
TVLNDSRFYCVDVYRTCNDETNLNFIKYTDLLKRNNHLYLRSDYGYPDDYAMHEMYLFRGDYIEITKKNIIRCGYYFSLKDSSKNELYISKGNTRRKLNNMKEKEACSITKKDTVKKFEIDILGKKLGEVKKYGKPLSLLPEKN

SEQ ID NO: 10906 - protein, 89 aa, unidentified
  REGION 1..89: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYM

SEQ ID NO: 10907 - protein, 142 aa, unidentified
  REGION 1..142: note = Description of Unknown:uncultivated organism sequence
AVLDNSYYYCVEVYRTRSGNIDLQGIKYTDLVNKNKKFYLKPGYKYPESYYKYIMYLFEGDYLRIKGPKSTRLGFYKAVNNINQNSIKITRYNSKYTRAFREESTTISADAEIEKIYVDILGKKGKVLTKHGEPLSLLPEKN

SEQ ID NO: 10908 - protein, 160 aa, unidentified
  REGION 1..160: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKCGEPYRCFRRKIEHKGQLAYSIKCRSRK

SEQ ID NO: 10909 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVQKFEIDILGKKLGEVKKYGKPLSLLPEKN

SEQ ID NO: 10910 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNIICCGYYFSLKDSSRNELYISKGNTRRKLNNMKEKEACSITKKDTVKKFEIDILGKKLGEVKKYGEPLSLLPEKN

SEQ ID NO: 10911 - protein, 142 aa, unidentified
  REGION 1..142: note = Description of Unknown:uncultivated organism sequence
AVLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLIKCGEPLSLLPEKN

SEQ ID NO: 10912 - protein, 139 aa, unidentified
  REGION 1..139: note = Description of Unknown:uncultivated organism sequence
SLLPDTSYYCVEIYRDEKGRTCAAGIAFSDIVVRGGRVRLREGFAHPEGYKEHCLYLFTNDYIRITNAKGVKFEGYYRSVYSINQAEFYYMRRNTPLRAKKYFTLAFRDTVEKLSVDPIGRIGGVIGCGEPLLSVRESE

SEQ ID NO: 10913 - protein, 144 aa, unidentified
  REGION 1..144: note = Description of Unknown:uncultivated organism sequence
TVLNDSRFYCVDVYRTCNDETNLNFIKYTDLLKRNDHLYLRSDYRYPDDYAMHEMYLFRGDYIEITKKNKICCGYYFSLKDSSKNELYISKGNTRRKLNNMKEKEACSITKKDTVKKFEIDILGKKLGEVKKYGEPLSLLPEKN

SEQ ID NO: 10914 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNIIRCGYYFSLKDSSKNELYMSKGNTRRKLNNMKENEVCSITKKDTVKKFEIDILGKKLGEVKKCGEPLSLLPEKN

SEQ ID NO: 10915 - protein, 142 aa, unidentified
  REGION 1..142: note = Description of Unknown:uncultivated organism sequence
AVLDNSYYYCVEVYRTRSGNIDLQGIKYTDLVNKNKKLYLKPCFKYPENYYKHIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 10916 - protein, 142 aa, unidentified
  REGION 1..142: note = Description of Unknown:uncultivated organism sequence
AVLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTTISADAEIEKIYVDILGKKGKVLTRHGEPLSLLPEKN

SEQ ID NO: 10917 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 10918 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNMKENEVCSITKKDTVKKFEIDILGKKLGEVKKYGEPLSLLPEKN

SEQ ID NO: 10919 - protein, 142 aa, unidentified
  REGION 1..142: note = Description of Unknown:uncultivated organism sequence
AVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTTISADAEIEKIYVDILGKKGKVLTKHGEPLSLLPEKN

SEQ ID NO: 10920 - protein, 142 aa, unidentified
  REGION 1..142: note = Description of Unknown:uncultivated organism sequence
AVLDNSYYYCVEVYRTRSGNTDLQGIKYTDLVNKNKKLYLKPCYKYPENYYKHIMYLFKGDYLRIKGPKSTRLGFYKAVNNINQNSIKITRYNSKYTRAFREESTAISADAEIEKIYVDILGKKGKVLTKCGEPLSLLPEKN

SEQ ID NO: 10921 - protein, 144 aa, unidentified
  REGION 1..144: note = Description of Unknown:uncultivated organism sequence
KVLNDSRFYCVDVYRTCNDETNLNFIKYTDLLKRNNHLYLRSDYRYPDDYAMHEMYLFYGDYIEITKKNKICCGYYFSLKNSSRNELYMSKGNTRRKLNNVKENEVCSITKKDTVKKFEIDILGKKLGEVKKYGEPLSLLPEKN

SEQ ID NO: 10922 - protein, 142 aa, unidentified
  REGION 1..142: note = Description of Unknown:uncultivated organism sequence
AVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTKAFREEATTISADAEIEKIYVDILGKKGKVLTKHGEPLSLLPEKN

SEQ ID NO: 10923 - protein, 144 aa, unidentified
  REGION 1..144: note = Description of Unknown:uncultivated organism sequence
TVLNDSRFYCVDVYRTCNDETNLSFIKYTDLLKRNNHLYLRSDYRYPDDYAMHEMYLFYGDYIEITKKNKICCGYYFSLKNSLRNELYISKGNTRRRLNNMKENEVCSITKKDTVKKFEIDILGKKLGEVKKYGEPLSLLPEKN

SEQ ID NO: 10924 - protein, 144 aa, unidentified
  REGION 1..144: note = Description of Unknown:uncultivated organism sequence
AYMDDRSYYCVDVYENYKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIDKCGEPLSYLPEKD

SEQ ID NO: 10925 - protein, 142 aa, unidentified
  REGION 1..142: note = Description of Unknown:uncultivated organism sequence
AVLDNSYYYCVEVYRTRSGNIDLQGIKYTDLVNKNKKLYLKPCYKYPENYYKYIMYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 10926 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYIEITKKNIIRCGYYFSLKDSSKNELYISKGNTRRKLNNMKEKEVCSITKKDTVKKFEIDILGKKLGEVKKYGEPLSLLPEKN

SEQ ID NO: 10927 - protein, 144 aa, unidentified
  REGION 1..144: note = Description of Unknown:uncultivated organism sequence
TVLNDSRFYCVDVYRTCNDETNLSFIKYTDLLKRNNHLYLRSDYRYPDDYAMHEMYLFYGDYIEITKKNKICCGYYFSLKNSLRNELYISKGNTRRRLNNMKENEVCSITKKDTVKKFEIDILGKKLGEVKKCGEPLSLLPEKN

SEQ ID NO: 10928 - protein, 142 aa, unidentified
  REGION 1..142: note = Description of Unknown:uncultivated organism sequence
AVLDNSYYYCVEVYRTRSGNIDLQGIKYTDLVNKNKKLYLKPCYKYPENYYKHIIYLFKGDYLRIKGPKSTRLGFYKAVNNINQNSIKITRYNSKYTRAFREESTAISADAEIEKIYVDILGKKGKVLTKHGEPLSLLPEKN

SEQ ID NO: 10929 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFRGDYVEITKKNIIRCGYYFSLKDSSKNELYISKGNTRRKLNNMKEKEACSITKKDTVKKFEIDILGKKLGKVKKYGKPLSLLPEKN

SEQ ID NO: 10930 - protein, 144 aa, unidentified
  REGION 1..144: note = Description of Unknown:uncultivated organism sequence
TVLNDSRFYCVDVYRTCNDETNLNFIKYTDLLKRNNHLYLRSDYRYPDDYAMHEMYLFYGDYIGITKKNKICCGYYFSLKNSSRNELYMSKGNTRRKLNNMKENEVCSITKKDTVKKFEIDILGKKLGEVKKYGEPLSLLPEKN

SEQ ID NO: 10931 - protein, 144 aa, unidentified
  REGION 1..144: note = Description of Unknown:uncultivated organism sequence
AYMDDRSYYCVDVYENHKGNTKITALKYNDIIKKNGKLYLKQDYKFPEDYREHLMYLYSGDFISVENKNSKYYGYYVSVKNINRNLLNIDECFYENKVIDYKKRIERAITERSIVKKYYIDILGKIGGEIDKCGEPLSYLPEKD

SEQ ID NO: 10932 - protein, 94 aa, unidentified
  REGION 1..94: note = Description of Unknown:uncultivated organism sequence
AYMDDRSYYCVDVYENHKGNTKITALKYNDIIKKNGKLYLKQDYKFPEDYREHLMYLYSGDFISVENKNSKYYGYYVSVKNINRNFLNIDEFIY

SEQ ID NO: 10933 - protein, 146 aa, unidentified
  REGION 1..146: note = Description of Unknown:uncultivated organism sequence
SYINNSCYYCTEVYKTTKGKTSITGIKYTDIVNKDKKLYLKPCYRYPEDYAEHTMYLFKGDYIEIFQKNVKDSSSKVKRRGFYLSVYNINEKRICMTKNNSRRNSENCNIAQKDNIEKYYIDILGKKRGVIKKKCGEPLSLLREND

SEQ ID NO: 10934 - protein, 153 aa, unidentified
  REGION 1..153: note = Description of Unknown:uncultivated organism sequence
SFMDDSCYYCVEVYTTKSGKTSLLGIKRTDIVKKDKKLYLKPYYKYPEDYAEHIMYLFKGDYIEISQKIAKTNTEKVKRRGFYLSINNINQNSIVITKDNTRRKLSNTNRVETCSISQKDIIKKYDIDILGKKGGEIKECGEPLSLLPENDLT

SEQ ID NO: 10935 - protein, 143 aa, unidentified
  REGION 1..143: note = Description of Unknown:uncultivated organism sequence
SDLPDTSYYCVEVYRDGAGKTRTAGIAFSDITVQNGKVCLKESCHRPADYKEHCLYLFTNDYIRVIKKTKKGDEVKFEGYYRSVANINQSAFAYQKYNTPAQRGKVFLIGQNDTVEKFEVDPIGKIGGKIRCGEPLSSAKARG

SEQ ID NO: 10936 - protein, 126 aa, unidentified
  REGION 1..126: note = Description of Unknown:uncultivated organism sequence
EKYVKTGKLDVLISAKKNVEFYDMLVKTLKESVFAKRVGAKSPSFCDTITNGRDKFIALPVIDEKDNRNKVVKRGQLYVLYQILSATSIGGNAADLEAIGGVKSSGIIRCPGASLPVREPSGRVQV

SEQ ID NO: 10937 - protein, 162 aa, unidentified
  REGION 1..162: note = Description of Unknown:uncultivated organism sequence
QHQYSRTDGNYVCAIYEGSDNKGNRKRSFEIISNLVAAKAFNTNQPIVPETNEKGYPLIMTLHLGDLVLLYEQSPDELRNASQKELVKRLYKITGMTDSGGLQITMRYQQEARPDKELQQINGLFRADEPIKYLRMLRHTQINAFVQGQDFELTETGKIVFK

SEQ ID NO: 10938 - protein, 164 aa, unidentified
  REGION 1..164: note = Description of Unknown:uncultivated organism sequence
RCHYSLTNGNFMSAIYEGIDKRDVRRRSFVIISLFEAARAYTQRNSLVPQISKEGYQLKMTLRIGDLVLLYTNTPNEIYNADQKELVNRLYEVTGMSDSGGLQIKLKHHQVAKPSGELKQVNGEYAGSSPVEEYRMLRHSQINALVQGQDFEITDTGKITFLHA

SEQ ID NO: 10939 - protein, 255 aa, unidentified
  REGION 1..255: note = Description of Unknown:uncultivated organism sequence
HHYYAQNDENYCMAIYEGVNDKGKTERAYDLVNNIDASEFFKLSKRKERKDGNISLFPEKHIESEYQLKLQNFKPCILKKGISCILLTDEDEDVEWDNQDWLKSRVYVLTGIDGDGIKLKHNQDARSGADAIKYMNDKVNILKFQSVLPELEKINDIDINSIKADFFNTEIRTKDVFDSIQKQINSYYKENNTLDSKGKLKTLKLKESGLTTPKGGDVIDNYKSFPYVKFKVSGFHAKIENIDFKITPTGKIIKI

SEQ ID NO: 10940 - protein, 176 aa, unidentified
  REGION 1..176: note = Description of Unknown:uncultivated organism sequence
RTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVSGISSMVITNNKYGVLQLRHSQKAGKYEKGKNGAYVVGENLRSTITMLHTQFKALIQNQDFTIDVLGKIKFLKHD

SEQ ID NO: 10941 - protein, 168 aa, unidentified
  REGION 1..168: note = Description of Unknown:uncultivated organism sequence
RTGHFKNDGNYCIAIYEQVLPQGSTAKAKRSFRIINNLAAASHFKVGNRANRAELYPPVDENGYRLKAILHQGDSVLLYENSPEEVYNATAAELCRRLYVVTMIKTDGRINLKHSQQAKAKEGLAGDYKTGEVLRPYILVSSSKFKALIQNRDFTIDVLGKIKFLKHD

SEQ ID NO: 10942 - protein, 176 aa, unidentified
  REGION 1..176: note = Description of Unknown:uncultivated organism sequence
RTGHFKNDGNYCIAIYEQVLPQGSTAKAKRSFRIINNLAAASHFKVGNRANRAELYPPVDENGYRLKAALHQGDSVLLYENSPEEVYNASAAELCRRLYVVSGISSMVITNNKYGVLQLRHSQKAGKYEKGKNGAYVVGENLRSTITMLHTQFKALIQNQDFTIDVLGKIKFLKHD

SEQ ID NO: 10943 - protein, 164 aa, unidentified
  REGION 1..164: note = Description of Unknown:uncultivated organism sequence
RTGHFLNDGNYCIAIYEQILPEGSTTKAKRSFLIVNNLAAVSYFKISNRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNQDFTVDVLGKIKFLKHD

SEQ ID NO: 10944 - protein, 176 aa, unidentified
  REGION 1..176: note = Description of Unknown:uncultivated organism sequence
RTGHFTNDGNYCIAIYEQVLPEGSTAKAKRSFRIVNNLAAASHFKLGNRTNRTELYPPVDENGYRLKAVLHQGDSVLLYEKSPEEIYNASAAELCRRLYVVAGISSTVISNNKYGRLQLRHSQNAGKYESGKNGAYTAGENLRPTITMLHTQLNALIQNQDFTIDVLGKIKFLKHD

SEQ ID NO: 10945 - protein, 164 aa, unidentified
  REGION 1..164: note = Description of Unknown:uncultivated organism sequence
RTGHFLNDGNYCIAIYEQILPEGSTTKAKRSFLIVNNLAAVSYFKISNRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNQDFTIDVIGKIKFLKHD

SEQ ID NO: 10946 - protein, 176 aa, unidentified
  REGION 1..176: note = Description of Unknown:uncultivated organism sequence
RTGHFINDGNYCIAIYEQVLSEGSTVKAKRSFRIVNNLAAASHFKIGNRTNRTELYPPVDENGYRLKAVLHQGDSVLLYEKSPEEIYNASAAELCRRLYVVAGITSMVISNNKYGRLQLRHSQNAGKYESGKNGAYTAGENLRSTITMLHTQLNALIQNQDFTIDVLGKIKFLKHD

SEQ ID NO: 10947 - protein, 168 aa, unidentified
  REGION 1..168: note = Description of Unknown:uncultivated organism sequence
RTGHFINDGNYCIAIYEQVLPEGSTAKAKRSFRIVNNLAAASHFKLGNRANRTELYPPVDENGYRLKAVLHQGDSVLLYEKSPEEIYNASAAELCRRLYVVTMIWTDGRVNLRYSQYTRAGKGVAGDYKTGELLRPHIMVSSSKFKALIQNQDFIIDVLGKIKFLKHD

SEQ ID NO: 10948 - protein, 168 aa, unidentified
  REGION 1..168: note = Description of Unknown:uncultivated organism sequence
RTGHFINDGNYCIAIYEQVLPEGSTAKAKRSFRIVNNLAAASHFKLGNRTNRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 10949 - protein, 177 aa, unidentified
  REGION 1..177: note = Description of Unknown:uncultivated organism sequence
RTGHFINDGNYCIAIYEQDLPEGSTAKAKRSFRIVNNLAAASHFKLGNRTNRTELYPLVDENGYRLKAVLHQGDSVLLYEKSPEEIYNASAAELCRRLYVVSGISSMVFTKSRSYGVLQLRHSQNASKSEKGKNGAYIVGENLRPTITMLHTQLNALIQNQDFTIDVIGKIKFLKHD

SEQ ID NO: 10950 - protein, 165 aa, unidentified
  REGION 1..165: note = Description of Unknown:uncultivated organism sequence
RTGHFINDGNYCIAIYEQVLPEGSTAKAKRSFRIVNNLAAASHFKLGNRTELYPPVDENGYRLKAVLHQGDSVLLYEKSPEEIYNASAAELCRRLYVVTMIKTDGRINFKHSQQAKAKEGLAGDYKIGEVLRPYILVSSSKFKALIQNRDFTIDVLGKIKFLKHD

SEQ ID NO: 10951 - protein, 176 aa, unidentified
  REGION 1..176: note = Description of Unknown:uncultivated organism sequence
RTGHFINDGNYCIAIYEQDLPEGSTAKAKRSFRIVNNLAAASHFKLGNRANRTELYPPVDENGYRLKAVLRQGDSVLLYEKSPEEIYNASAAELCHRLYVVAGITSMVISNNKYGRLQLRHSQNAGKYESGKNGAYTAGENLRPTITMYHTQLKALIQNRDFTIDVLGKIKFLKRD

SEQ ID NO: 10952 - protein, 176 aa, unidentified
  REGION 1..176: note = Description of Unknown:uncultivated organism sequence
RTGHFINDGNYCIAIYEQVLPEGSTAKAKRSFRIVNNLAAASHFKLGNRTNRTELYPPVDENGYRLKAVLHQGDSVLLYEKSPEEIYNASAAELCRRLYVVAGITSMVISNNKYGRLQLRHSQNAGKYESGKNGAYTAGENLRPTITMLHTQLNALIQNQDFTIDVLGKIKFLKHD

SEQ ID NO: 10953 - protein, 176 aa, unidentified
  REGION 1..176: note = Description of Unknown:uncultivated organism sequence
RTGHFTNDGNYCIAIYEQVLPEGSTAKAKRSFRIVNNLAAVSYFKISNRTNRTELYPPVDENGYRLKAVLHQGDSVLLYEKSPEEIYNASAAELCRRLYVVAGISSTVISNNKYGRLQLRHSQNAGKYESGKNGAYTAGENLRPTITMLHTQLNALIQNQDFTIDVLGKIKFLKHD

SEQ ID NO: 10954 - protein, 176 aa, unidentified
  REGION 1..176: note = Description of Unknown:uncultivated organism sequence
RTGHFTNDGNYCIAIYEQVLPKGSTAKAKRSFLIVNNLAAVSYFKISNRANRAELYPPVDENGYRLKAVLHQGDSVLLYEKSPEEIYNASAAELCSRLYVVAGITSMVISNNKYGRLQLRHSQNAGKYESGKNGAYTAGENLRPTITMLHTQLNVLIQNQDFTIDVLGKIKFLKRD

SEQ ID NO: 10955 - protein, 168 aa, unidentified
  REGION 1..168: note = Description of Unknown:uncultivated organism sequence
RTGHFINDGNYCIAIYEQVLPEGSTAKAKRSFRIVNNLAAASHFKLGNRTNRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKHD

SEQ ID NO: 10956 - protein, 167 aa, unidentified
  REGION 1..167: note = Description of Unknown:uncultivated organism sequence
RTGHFTNDGNYCIAIYEQVLPEGSTAKAKRSFRIVNNLAAASHFKLGNRTNRTELYPPVDENGYRLKAVLHQGDSVLLYEKSPEELYNASAAELCRRLYIITSMEADGRINFKQAQLSQSGRKKKEDDKLGFFCPYMRINAKSLNALIQNQDFTIDVLGKIKFLKHD

SEQ ID NO: 10957 - protein, 177 aa, unidentified
  REGION 1..177: note = Description of Unknown:uncultivated organism sequence
RTGHFINDGNYCIAIYEQDLPEGSTAKAKRSFRIVNNLAVASHFKLGNRANRTELYPPVDENGYRLKAVLRQGDSVLLYEKSPEEIYNASAAELCRRLYVVAGISSMVFTKSRSYGVLQLRHSQNASKSEKGKNGAYIVGENLRPTITMLHTQLNALIQNRDFTINVLGKIKFLKRD

SEQ ID NO: 10958 - protein, 168 aa, unidentified
  REGION 1..168: note = Description of Unknown:uncultivated organism sequence
RTGHFINDGNYCIAIYEQVLPEGSTAKAKRSFRIVNNLAAASHFKLGNRTNRTELYPPVDENGYRLKAVLHQGDSVLLYEKSPEEIYNASAAELCRRLYVVTMIKTDGRINFKHSQQAKAKEGLAGDYKIGEVLRPYILVSSSKFKALIQNRDFTIDVLGKIKFLKHD

SEQ ID NO: 10959 - protein, 168 aa, unidentified
  REGION 1..168: note = Description of Unknown:uncultivated organism sequence
RTGHFINDGNYCIAIYEQVLPEGSTAKAKRSFRIVNNLAAASHFKLGNRTNRTELYPPVDENGYRLKAVLHQGDSVLLYEKSPEEIYNASATELCRRLYVVTMIKTDGRINFKHSQQAKAKEGLAGDYKIGEVLRPYILVSSSKFKALIQNRDFTIDVLGKIKFLKHD

SEQ ID NO: 10960 - protein, 176 aa, unidentified
  REGION 1..176: note = Description of Unknown:uncultivated organism sequence
RTGHFINDGNYCIAIYEQVLPEGSTAKAKRSFRIVNNLAAASHFKLGNRTNRTELYPPVNENGYRLKAVLHQGDSVLLYEKSPEEIYNASNAELCRRLYVVAGITSMVISNNKYGRLQLRHSQNAGKYESGKNGAYTAGENLRPTITMYHTQLKALIQNRDFTIDVLGKIKFLKRD

SEQ ID NO: 10961 - protein, 168 aa, unidentified
  REGION 1..168: note = Description of Unknown:uncultivated organism sequence
RTGHFINDGNYCIAIYEQVLPEGSTAKAKRSFRIVNNLAAASHFKLGNRTNRTELYPPVDENGYRLKAVLHQGDSVLLYEKSPEEIYNASAAELCRRLYVVTMIKTDGRVNLRYSQYTRAGKGVAGDYKTGELLRPHIMVSSSKFKALIQNQDFTIDVLGKIKFLKRD

SEQ ID NO: 10962 - protein, 165 aa, unidentified
  REGION 1..165: note = Description of Unknown:uncultivated organism sequence
RTGHFTNDGNYCIAIYEQVLPEGSTAKAKRSFRIVNNLAAASHFKLGNRTELYPPVDENGYRLKAVLRQGDSVLLYEKSPEEIYNASAAELCRRLYVVTMIKTDGRVNLRYSQYTRAGKGVAGDYKTGELLRPHIMVSSSKFKALIQNQDFTIDVLGKIKFLKHD

SEQ ID NO: 10963 - protein, 164 aa, unidentified
  REGION 1..164: note = Description of Unknown:uncultivated organism sequence
RTGHFLNDGNYCIAIYEQILPEGSTTKAKRSFLIVNNLAAVSYFKISNRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNQDFTIDVLGKIKFLKHD

SEQ ID NO: 10964 - protein, 176 aa, unidentified
  REGION 1..176: note = Description of Unknown:uncultivated organism sequence
RTGHFINDGNYCIAIYEQVLPEGSTAKAKRSFRIVNNLAAASHFKLGNRTNRTELYPLVDENGYRLKAVLHQGDSVLLYEKSPEEIYNASAAELCRRLYVVAGITSMVISNNKYGRLQLRHSQNAGKYESGKNGAYTAGENLRPTITMLHTQLNALIQNQDFTIDVLGKIKFLKHD

SEQ ID NO: 10965 - protein, 177 aa, unidentified
  REGION 1..177: note = Description of Unknown:uncultivated organism sequence
RTGHFINDGNYCIAIYEQVLPEGSIAKAKRSFRIVNNLAAASHFKLGNRTNRTELYPPVDENGHRLKAVLRQGDSVLLYEKSPEEIYNASAAELCRRLYVVAGISSMVFTKSRSYGVLQLRHSQNASKSEKGKNGAYIVGENLRPTITMLHTQLNALIQNQDFTIDVIGKIKFLKHD

SEQ ID NO: 10966 - protein, 177 aa, unidentified
  REGION 1..177: note = Description of Unknown:uncultivated organism sequence
RTGHFINDGNYCIAIYEQDLPEGSTAKAKRSFRIVNNLAAASHFKLGNRANRTELYPPVDENGYRLKAVLRQGDSVLLYEKSPEEIYNASAAELCRRLYVVAGISSMVFTKSRSYGVLQLRHSQNASKSEKGKNGAYIVGENLRPTITMLHTQLNALIQNRDFTIDVLGKIKFLKRD

SEQ ID NO: 10967 - protein, 177 aa, unidentified
  REGION 1..177: note = Description of Unknown:uncultivated organism sequence
RTGHFMNGGNYCIAIYEQDLPEGSTAKAKRSFRIVNNLAVASHFKLGNRANRTELYPPVDENGYRLKAVLRQGDSVLLYEKSPEEIYNASAAELCRRLYVVAGISSMVFTKSRSYGVLQLRHSQNASKSEKGKNGAYIVGENLRPTITMLHTQLNALIQNRDFTIDVLGKIKFLKRD

SEQ ID NO: 10968 - protein, 168 aa, unidentified
  REGION 1..168: note = Description of Unknown:uncultivated organism sequence
RTGHFINDGNYCIAIYEQDLPEGSTAKAKRSFRIVNNLAAASHFKLGNRANRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 10969 - protein, 176 aa, unidentified
  REGION 1..176: note = Description of Unknown:uncultivated organism sequence
RTGHFINDGNYCIAIYEQDLPEGSTAKAKRSFRIVNNLAAASHFKLGNRANRTELYPPVDENGYRLKAVLRQGDSVLLYEKSPEEIYNASAAELCRRLYVVAGITSMVISNNKYGRLQLRHSQNAGKYESGKNGAYTAGENLRPTITMYHTQLKALIQNRDFTIDVLGKIKFLKRD

SEQ ID NO: 10970 - protein, 167 aa, unidentified
  REGION 1..167: note = Description of Unknown:uncultivated organism sequence
RTGHFLNDGNYCIAIYEQILPEGSTTKAKRSFLIVNNLAAVSYFKISNRANRAELYPSVDENGYRLKAVLHQGDSVLLYEKSPEEIYNASAAELCRRLYIITSMEADGRINFKQAQLSQSGRKKKEDDKLGFFCPYMRINAKSLNALIQNRDFTIDVLGKIKFLKHD

SEQ ID NO: 10971 - protein, 168 aa, unidentified
  REGION 1..168: note = Description of Unknown:uncultivated organism sequence
RTGHFMNGGNYCIAIYEQDLPEGSTAKAKRSFRIVNNLAVASHFKLGNRANRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKRD

SEQ ID NO: 10972 - protein, 168 aa, unidentified
  REGION 1..168: note = Description of Unknown:uncultivated organism sequence
RTGHFLNDGNYCIAIYEQILPEGSTAKAKRSFRIVNNLAVASHFKLGNRANRTELYPPVDENGYRLKAVLRQGDSVLLYEKSPEEIYNASAAELCRRLYVVTMIWTDGRVNLRYSQYTRAGKGVAGDYKTGELLRPHIMVSSSKFKALIQNQDFTIDVLGKIKFLKHD

SEQ ID NO: 10973 - protein, 166 aa, unidentified
  REGION 1..166: note = Description of Unknown:uncultivated organism sequence
QYYYVSPGEAYGVFEYVSKDGERLYESDNLFTLSEKMKNGTLTEIPCPKRITDKKGKEYVHTRTILKDATILIYPSSEREEDQYLLDTVTLSKRLYRINSIEKDRKRLTLTRHNIVKSYAGIETIAESDFYNLPDGMRMPISKLHFLLLESDFDIFDGKIVPIKND

SEQ ID NO: 10974 - protein, 166 aa, unidentified
  REGION 1..166: note = Description of Unknown:uncultivated organism sequence
RFYYVSSHGEAYGIFEYRSDEGKILYESDSLFTLSTKMKNGEMKEIPCPQHIIRTGKRFVHTRTIRKGDSILIYPEEEKPEDQYKLNTAILSNRLYRVDSIELDKRINLVRHFRGSMPKGKAIKKDADYNNLPEAIRPTLSDKLHFLLLGTDFDILNGKIVPLKND

SEQ ID NO: 10975 - protein, 159 aa, unidentified
  REGION 1..159: note = Description of Unknown:uncultivated organism sequence
RQFHVKNDTNYMVAIYEGENMSQRSYDVVSNLKAVKLLNNNVALFPQIDEKGYHLITCLKVGDMVLLYEKNSEELKTASQQELVKHLFKVVGLALSGGIQIKLNYHQEARPSGDLHQINGPYRFNEPIAARRMLTHSQINALVQGQDFEISDTGKITFK

SEQ ID NO: 10976 - protein, 169 aa, unidentified
  REGION 1..169: note = Description of Unknown:uncultivated organism sequence
RYHYSMTNGNYVSAIYEGTDGNGKRKRAFEIFSLFDAAKAYGQKMPIVPKVSKEGYPLIMTLKLGDLVLLYENNPDEIRNASQEEMTKRLYKVTGMSDSNGLQITLRYQQEARDAGTLKTIFGNPKTGLFSSQQEIQPRRMLLHTQINALVQGQHFEISDTGKISFKQC

SEQ ID NO: 10977 - protein, 163 aa, unidentified
  REGION 1..163: note = Description of Unknown:uncultivated organism sequence
RAVHVDNDTNNLFLIYEGLNQKGQLARSFSVLSNIEAAKRYNSKTDQEIIPQINEDGYSLKMIIRVGSLILLYKDKPEELRNLSISSLVKRLYKVIGFGKDGRIKIRYQQEAKEAKELGGFLALDYNTLEVITSQARIGYAKMNALVQGQDFDISDTGKITFK

SEQ ID NO: 10978 - protein, 150 aa, unidentified
  REGION 1..150: note = Description of Unknown:uncultivated organism sequence
NMIYYETNGNSCIGYYSNGKHVVLSIADEASGKRLERSIKDKKTSQEHQLKYIIRLGDTVILMKNNETEDDIRKLDTNDLKKRIYRLVGIESDKRIKFLRHDVPSTDNCETFYTNISEIDRTDVKGFRLSNAKLIKDSQIVTKIVFNDYH

SEQ ID NO: 10979 - protein, 164 aa, unidentified
  REGION 1..164: note = Description of Unknown:uncultivated organism sequence
QYYYVSPGEAYGIFEYKNNDGTLHYTLDNLFTLSEKMKNGNLRETPCPQNIMVKGVEFFHTRTILKESTILIYPSTECPEDQYKLKSTTISRRLFRINSIQQDKRIKLTRHNLAKSWTEINTIKDSDFDNLPDGMRMPIAKLHFLLLGTDFDIIDGRIVPIKHD

SEQ ID NO: 10980 - protein, 163 aa, unidentified
  REGION 1..163: note = Description of Unknown:uncultivated organism sequence
RSHYSMTNGNFMSAIYEGTDAKGKKKRSFVIISLYEAAQAYGKHEPLVPTVSEEGYALIKTIRLGDLVLLYENSPEEIYTASQEELVKRMYEIIGMSDSKGLQIRLKHQQEARPNGELQQINGAFKNGDSAPIRMLLHTQFNALVQGQDFNISDTGKITFKSC

SEQ ID NO: 10981 - protein, 163 aa, unidentified
  REGION 1..163: note = Description of Unknown:uncultivated organism sequence
RSHYSLTNGNYMAAIYEGIDDKGKTKRTFEIISLFEAAQAYSKNAPLVPQTKDGYPLIKTIRLGDLVLLYEKSPEEIYYASREDLVKRLYEIVGMSDSGGLQIKLKYQQEAKPAGELKQVNGAFTANAPIDSFRMLRHSQFNALVQGQDFDISDTGKITFRSC

SEQ ID NO: 10982 - protein, 165 aa, unidentified
  REGION 1..165: note = Description of Unknown:uncultivated organism sequence
RSHYSMTNGNFMSAIYEGLDAKGKKKRSFVIISLFEAAQAYGKREPLVPKVSKDGYALIKTIRLGDLVLLYENSPKEIYNASQEELVKRMYEIVGMSDSGGGLQITLKYQQEAKPNGELKQVNGAFAADAPIANFRMLRHTQFNALVQGQDFDISDTGKITFRSC

SEQ ID NO: 10983 - protein, 166 aa, unidentified
  REGION 1..166: note = Description of Unknown:uncultivated organism sequence
QYYYVSSHGEAYGVFEYKSKDGKLIYESDSLFTLSQKMKLGELKELPCPKHIIRKGKDYFYTRSILKEDTILVYPSKEKPEDQFSLEPKEISMRLYRVDSVSIDKRLSLTRHIFSGGLPRGNAFKESDFEHLPETIRPTVSDKLHFLVLGTDFDIINGRMVQKTDE

SEQ ID NO: 10984 - protein, 166 aa, unidentified
  REGION 1..166: note = Description of Unknown:uncultivated organism sequence
QYYYVSPGEAYGIFEYKSSDGKFIYETDNLFSLSMKMKNGELKELPCPKHIIRKGKEYTHTRTILKENTILVYPPKEQQEDQFKLTPAEISKRLYRINSIELPNRIKLTRHNLAESFKGRDTITDDDFNNLPDGFRKSVTTLKFLLLGKDFDIINGKMVPISKTDE

SEQ ID NO: 10985 - protein, 166 aa, unidentified
  REGION 1..166: note = Description of Unknown:uncultivated organism sequence
RFHYSRPDGNYVAAIYEGTDKKGNRKRTSVIVTNLDAAKAFNKHQPLVPETKEGYALLCTIKKGDLVLLYENSPEELRNATQAELSKRLYKIAKMYDSGGLQITIRHHQEAREATKLKELYGNPKTGLFDSSQEIYPQRRLSYNQFNALVQGQHFELTETGKIVFK

SEQ ID NO: 10986 - protein, 166 aa, unidentified
  REGION 1..166: note = Description of Unknown:uncultivated organism sequence
QYYYVSPGEAYGVFEYISKNGERLYESDNLFTLSEKMKNGTLTETPCPKCITDKKGKEYVHTRTVLKDAIILIFPSSERAEDQYQLDAATVSKRLYRINTIEMQRKRLTLTRHNLVKSWTGTNTICDSDFKDLPDGMRMSITKLHFLLLGKDFDIIDGKIVPLKKE

SEQ ID NO: 10987 - protein, 166 aa, unidentified
  REGION 1..166: note = Description of Unknown:uncultivated organism sequence
RFYYVSSHGEAYGIFEYKSDEGKILYESDSLFTLSTKMKNGEMKEIPCPQHIIRTGKRFIHTRTIRKGDSILIYPEEEKPEDQYKLNTAILSNRLYRVDSIELDKRINLVRHFRGSMPKGKAIKKDADYNNLPEAIRPTLSDKLHFLLFGTDFDILNGKIVPLKND

SEQ ID NO: 10988 - protein, 166 aa, unidentified
  REGION 1..166: note = Description of Unknown:uncultivated organism sequence
QYYYVSPGEAYGIFEYKSNDGKYIYETDNLFSLSQKMKNGELKELPCPKRIIRKGKEYTHTRTILKEDTILVYPPNEQPEDQFKLTPAEISKRLYRINSIELPNRIKLTRHNLAESFKGRDTITDADFADLPDGFRKSVTTLKFLLLGTDFDIVNGKMVPISKTDE

SEQ ID NO: 10989 - protein, 166 aa, unidentified
  REGION 1..166: note = Description of Unknown:uncultivated organism sequence
QYYYVSPGEAYGIFEYKSSDGKFIYETDNLFSLSMKMKNGELKELPCPKHIIRKGKEYTHTRTILKEDTILVYPPKEQQEDQFKLTPAEISKRLYRINSIELPNRIKLTRHNLAESFKGRDTITDDDFNNLPDGFRKSVTTLKFLLLGKDFDIINGKMVPISKTDE

SEQ ID NO: 10990 - protein, 164 aa, unidentified
  REGION 1..164: note = Description of Unknown:uncultivated organism sequence
QYYYVSPGEAYGIFEYKSSDGKFIYETDNLFSLSMKMKNGELKELPCPKHIIRKGKEYTHTRTILKEDTILVYPPKEQPEDQFKLTPAEISKRLYRINSIELPNRIKMTRHNLAESFKGRDTITDDDFNNLPDGFRKSLTTLNFLLLGKDFDIINGRMVQKTDE

SEQ ID NO: 10991 - protein, 166 aa, unidentified
  REGION 1..166: note = Description of Unknown:uncultivated organism sequence
QYYYVSPGEAYGVFEYISKDGERLYESDNLFTLSEKMKNGTLTETPCPKCITDKKGKEYVHTRTVLKDAIILIFPSSERAEDQYQLDAATVSKRLYRINTIEMQRKRLTLTRHNLVKSWTGKNTIDDTDFMNLPDGMRMSIKNLNFLLLGKDFDIIDGKIVPLKNN

SEQ ID NO: 10992 - protein, 144 aa, unidentified
  REGION 1..144: note = Description of Unknown:uncultivated organism sequence
DVFEKEGKYYCVPVYIKDIYAKHLPDRAILAHKRYEDWTKIDDSFRFLFALFRNDLIYVKAKKPFNLSPNDKEEKQSVSVSEGFFYYRGINISTGAALIITHDNSYSTELGLKTLLKIEKYAVDILGNKYPVKREKRLNTEWDS

SEQ ID NO: 10993 - protein, 166 aa, unidentified
  REGION 1..166: note = Description of Unknown:uncultivated organism sequence
DLYSKGGKYYGVPVYVADLYRGELPKRAATQRKSQNEWRVMNDTYTFEMSIYKDDLLRIESEDGIEMKKKKDVENSAKAPTKIITDDLVYFIGFDRSTVSIEIEDTTGCYFARGVGIQKKIDKITRCEIDVLGNVQEIKKKPKQPLPLKMLTDKERVEKRKNNQNK

SEQ ID NO: 10994 - protein, 149 aa, unidentified
  REGION 1..149: note = Description of Unknown:uncultivated organism sequence
DVFTKDGKFYLVPVYVSDVYAGRLPMKAATNGKTEEEWRDVSAGFDFLFSLHKNDMIYVENKNGMNLSKMIKEDKSKLPEKKTLNACFGYFNSMDRANVAIKFEDINGCYECRVGALNLKKFVKYEVDVLGEAHPVGCEKRQPLHRPRS

SEQ ID NO: 10995 - protein, 151 aa, unidentified
  REGION 1..151: note = Description of Unknown:uncultivated organism sequence
DVYTRGGKFYVVPVYVSDVYAGKLPMKAATSGKPEEEWRDVSDPNEYEFLFSLHKNDMIYVESKNGMNLSKMIKDDNSKLPEKKTVYGCFGYFNSMDRSTAGIKFEDVNGCYQCRVGTLNLKRFEKYEVDVLGDVHLVGREKRQPLNKPRS

SEQ ID NO: 10996 - protein, 148 aa, unidentified
  REGION 1..148: note = Description of Unknown:uncultivated organism sequence
DIFSKSNAGKKRYYAVPVYLIDVYKSQIPTKVCATGKAASKWDDISNGYAFEFSLYSGDLFRLKFADKLIPGILQKDGKTKILSQDEYFYYNGFDRSTNSISFKTHDDSMEFRSIGFQSAMIFEKYNVDLLGNISKVTSKKREMINKK

SEQ ID NO: 10997 - protein, 143 aa, unidentified
  REGION 1..143: note = Description of Unknown:uncultivated organism sequence
DVFEKDKKFYLCPVYMSDVYAHKLPNKVIEIGKDWTTIDKSFNFKFSLYQNDLVKITSKKDIVLKKTFDNPKSKKPDSINGKEMLVYYNSTGIAVASIKIQSHDNCYKQESLGVKTLLNMEKYYVDIMGNVYKAPENEKREKI

SEQ ID NO: 10998 - protein, 144 aa, unidentified
  REGION 1..144: note = Description of Unknown:uncultivated organism sequence
DVFEKEGKYYCVPVYIKDIYAKHLPDRAISAGKRFDDWVKIDDSFRFLFALFRNDLIYVKAKKPFNLSPNDKEEKQSVSVSEGFFYYRGIDCATGAALLIVHDNSYSTRLGFKTLLKIEKYAVDILGNKYPVKREKRLNTEWDS

SEQ ID NO: 10999 - protein, 165 aa, unidentified
  REGION 1..165: note = Description of Unknown:uncultivated organism sequence
DLYSKDGKYFGVPVYVADLYRGELPKRAATQNKPQNEWRVIDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 11000 - protein, 125 aa, unidentified
  REGION 1..125: note = Description of Unknown:uncultivated organism sequence
DIFRKDGKYYMVPVYYKDLYLHRMPTKAVVAHKETADWKEMDDKDFLFSLYPDDLIKVQKKNKEIENGYYKTSDRYSAGISYVQHDFGAKSYVRLCIQNLAIFEKLNVDILGNIYSCSKEEREWL

SEQ ID NO: 11001 - protein, 125 aa, unidentified
  REGION 1..125: note = Description of Unknown:uncultivated organism sequence
DIFRKDGKYYMVPVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 11002 - protein, 125 aa, unidentified
  REGION 1..125: note = Description of Unknown:uncultivated organism sequence
DIFRKDGKYYMVLVYYKDLYLHRMPTKAVVAHKETADWKEMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 11003 - protein, 165 aa, unidentified
  REGION 1..165: note = Description of Unknown:uncultivated organism sequence
DLYSKDGKYFGVPVYVADLYRGELPKRAATNGKPQNEWRVIDDTYTFEMSIYQDDLLRIESKKGIELKKNKDVENSAKATTKTITDDFAYFIGFNRSTASIKIEDTTGCYFAKSIGIQNIGKITKCEIDVLGNVQEIKKRPKQPQPLKMLTDKEKAEKRKNNQNK

SEQ ID NO: 11004 - protein, 164 aa, unidentified
  REGION 1..164: note = Description of Unknown:uncultivated organism sequence
DLYSKDGKYFGVPVYVADLYRGELPKKAATKRKTKNEWREMDDTYTFEMSIYKDDLLRIESEDGIELKKKKDVENSAKAPTKTIMDDFVYFIGFDTDSPRITIEDTTGCYCGRKGIQSIKKITKCEIDVLGNVQEIKKRPKQPQPLKMLTDKERAEKRKNNQNK

SEQ ID NO: 11005 - protein, 165 aa, unidentified
  REGION 1..165: note = Description of Unknown:uncultivated organism sequence
DLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 11006 - protein, 165 aa, unidentified
  REGION 1..165: note = Description of Unknown:uncultivated organism sequence
DLYSKDGKYFGVPVYVADLYRGELPKKAATHSKPQNEWRVIDDTYTFEMSIYQDDLLRIENKKGIELKKNKDVENSAKAASKTIVDDFVYYIGFDRSTVSIKVEDTTGCYFARGVGIQNIGKITKCEIDVLGNVQEIKKRPKQPQPLKMLTDKERAEKRKNNQNK

SEQ ID NO: 11007 - protein, 165 aa, unidentified
  REGION 1..165: note = Description of Unknown:uncultivated organism sequence
DLYSKDGKYFGVPVYVADLYRGELPKRAATANKPQNEWREMDDTYTFEMSIYQDDLLRIESKKGIELKKKKDVENSAKATSKTITDDFVYFIGFNRSTASIEVEDTTGCYRRDGIGTQNIGKITKCEIDVLGNVQEIKKRPKQPQPLKMLTDKEKAEKRKNNQNK

SEQ ID NO: 11008 - protein, 165 aa, unidentified
  REGION 1..165: note = Description of Unknown:uncultivated organism sequence
DLYSKDGKYFGVPVYVADLYRGELPKKAATHSKPQNEWRVIDDTYTFEMSIHQDDLLRIENKKGIELKKNKDVENSAKAATKTITDDFVYYIGFDRSTVSIKVEDTTGCYFARGVGIQNIGKITKCEIDVLGNVQEIKKRPKQPQPLKKLTDKERAEKRKNKQNK

SEQ ID NO: 11009 - protein, 165 aa, unidentified
  REGION 1..165: note = Description of Unknown:uncultivated organism sequence
DLYSKDGKYFGVPVYVADLYRGELPKKAATHSKPQNEWRVIDDTYTFEMSIHQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKILTDKERAEKRKNKQNK

SEQ ID NO: 11010 - protein, 125 aa, unidentified
  REGION 1..125: note = Description of Unknown:uncultivated organism sequence
DIFRKDGKYYMVPVYYKDLYLHRMPTKAVVAHKETADWKKMDDKDFLFSLYPDDLIKVQKKNKEIENGYYKTSDRYSAGISYVQHDLGAKSYVRLCIQNLAIFEKLNVDILGNIYSCSKEEREWL

SEQ ID NO: 11011 - protein, 165 aa, unidentified
  REGION 1..165: note = Description of Unknown:uncultivated organism sequence
DLYSKDGKYFGVPVYVADLYRGELPKRAATNGKQQNEWRVIDDTYTFEMSIYQDDLLRIESKKGIELKKNKDVENSAKATTKTITDDFAYFIGFDRSTASIKIEDTTGCYFAKSIGIQNIGKITKCEIDVLGNVQEIKKRPKQPQPLKMLNDKEKAEKRKNNQNK

SEQ ID NO: 11012 - protein, 144 aa, unidentified
  REGION 1..144: note = Description of Unknown:uncultivated organism sequence
DVFRKDGKYFCVPVYTKDIYAKRLPDRAITAGKKYADWDKIDGTFEFLFALFANDLIYVKARNSFKLKALDKEEKQQVSMSEGFFYYKGIDIATGAALLITHDHSYETRLGLKTLLRLEKYTVDVLGEKYPVRKEKRLNTEWDT

SEQ ID NO: 11013 - protein, 166 aa, unidentified
  REGION 1..166: note = Description of Unknown:uncultivated organism sequence
DLYSKGGKYYGVPVYVADLYRGELPKRAATQRKSQNEWRVMNDTYTFEMSIYKDDLLRIESEDGIEMKKKKDVENSAKAPTKIITDDLVYFIGFDRSTVSIEIEDTTGCYFARGVGIQKKIDKITRCEIDVLGNVQEIKKKPKQPQPLKMLTDKERVEKRKNNQNK

SEQ ID NO: 11014 - protein, 165 aa, unidentified
  REGION 1..165: note = Description of Unknown:uncultivated organism sequence
DLYSKDGKYFGVPVYVADLYRGELPKKAATHSKPQNEWRVIDDTYTFEMSIYQDDLLRIENKKGIELKKNKDVENSAKASTKIITDDFAYFISFDRSTASIKIEDTTGCYFAKSIGIQNIGKITKCEIDVLGNVQEIKKRPKQPQPLKMLTDKERAEKRKNKQNK

SEQ ID NO: 11015 - protein, 117 aa, unidentified
  REGION 1..117: note = Description of Unknown:uncultivated organism sequence
DVFKRKDEYYAVVVYYRDLYIGNLPNNAAHFDIEMKKGEFEFSLYKDDLIRFVKDGKEQYAYYKYINANNSQITYTEHDTSKETKCTTIRTLDKFQKMNVDLLGNIYSSDKEEREWN

SEQ ID NO: 11016 - protein, 165 aa, unidentified
  REGION 1..165: note = Description of Unknown:uncultivated organism sequence
DLYSKDGKYFGVPVYVADLYRGELPKRAATNGKSQNEWRVIDDTYTFEMSIYQDDLLRIENKKGIELKKNKDVENSAKAASKTIVDDFVYYIGFDRSTVSIKVEDTTGCYFARGVGIQNIGKITKCEIDVLGNVQEIKKRPKQPQPLKMLTDKERAEKRKNNQNK

SEQ ID NO: 11017 - protein, 164 aa, unidentified
  REGION 1..164: note = Description of Unknown:uncultivated organism sequence
DLYSKGGKYYGVPVYVADLYRGELPKKAATKRKSKDEWRVMDDTYTFEMSIYKDDLLRIESEDGIELKKNKDVENSAKAPTKTIMDDFVYFIGFDTDSPRITIEDTTGCYCGRKGIQSIKKITKCEIDVLGNVQEIKKRPKQPQPLKMLTDKERAEKRKNNQNK

SEQ ID NO: 11018 - protein, 165 aa, unidentified
  REGION 1..165: note = Description of Unknown:uncultivated organism sequence
DLYSKDGKYFGVPVYVADLYRGELPKRAATAGKPQNEWRVIDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 11019 - protein, 166 aa, unidentified
  REGION 1..166: note = Description of Unknown:uncultivated organism sequence
DLYSKDGKYFGVPVYVADLYRGELPKRAATQRKSQNEWRVMNDTYTFEMSIYKDDLLRIESEDGIELKKKKDVENSAKTPTKIITNDLVYFIGFDRSTVSIEIEDTTGCYFARGVGIQKKIDKITKCEIDVLGNVQEIKKRPKQPQPLKMLTDKEKAEKRKNNQNK

SEQ ID NO: 11020 - protein, 165 aa, unidentified
  REGION 1..165: note = Description of Unknown:uncultivated organism sequence
DLYSKDGKYFGVPVYVADLYRGELPKRAATAGKPQNEWRVIDDTYTFEMSIYQDDLLHIESKKGIEFKKNKDVENSAKASTKIIMDDFAYFISFDRATATIKIEDTTGCYFARSIGIQNIGKITKCEIDVLGNVQEIKKRPKQPQPLKMLTDKERAEKRMKNQNK

SEQ ID NO: 11021 - protein, 165 aa, unidentified
  REGION 1..165: note = Description of Unknown:uncultivated organism sequence
DLYSKDGKYFGVPVYVADLYRGELPKKAATKRKSKDEWRVMDDTYTFEMSIYQDDLLRIENKKGIELKKNKDVENSAKAASKTIVDDFVYYIGFDRSTVSIKVEDTTGCYFARGVGIQNIGKITKCEIDVLGNVQEIKKRPKQPQPLKMLTDKERAEKRKNNQNK

SEQ ID NO: 11022 - protein, 165 aa, unidentified
  REGION 1..165: note = Description of Unknown:uncultivated organism sequence
DLYSKDGKYFGVPVYVADLYRGELPKRAATNGKPQNEWRVIDDTYTFEMSIYQDDLLHIESKKGIEFKKNKDVENSAKASTKIITDDFAYFISFDRSTASIKIEDTTGCYFAKSIGIQNIGKITKCEIDVLGNVHEIKKRPKQPQPLKMLTDKERAEKRKKNQNK

SEQ ID NO: 11023 - protein, 165 aa, unidentified
  REGION 1..165: note = Description of Unknown:uncultivated organism sequence
DLYSKDGKYFGVPVYVADLYRGELPKRAATANKPQNEWREMDDTYTFEMSIYQNDLLRIESKKGIELKKDRNNEFSAKENSILLNDGYVYFTSFCISTAAIKIEDTTGCYVAPSVGIQNLKKITKCEIDVLGNVQEIKKRPKQPQPLKMLTDKERAEKRKNNQNK

SEQ ID NO: 11024 - protein, 165 aa, unidentified
  REGION 1..165: note = Description of Unknown:uncultivated organism sequence
DLYSKDGKYFGVPVYVADLYRGELPKRAATANKPQNEWREMDDTYTFEMSIYQDDLLHIESKKGIELKKKKDVENSAKALTKTITDDLVYFIGFNRSKASIEVEDTTGCYNMDGLGIQNVGKITKCEIDVLGNVQEIKKRPKQPQPLKMLTDKERAEKRKKNQNK

SEQ ID NO: 11025 - protein, 165 aa, unidentified
  REGION 1..165: note = Description of Unknown:uncultivated organism sequence
DLYSKDGKYFGVPVYVADLYRGELPRRAATQGKPQNEWREMDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKNKQNK

SEQ ID NO: 11026 - protein, 166 aa, unidentified
  REGION 1..166: note = Description of Unknown:uncultivated organism sequence
DLYSKDGKYFGVPVYVADLYRGELPKRAATQRKSQNEWRVIDDTYTFEMSVYKDDLLRIESEDGIEMKKKKDVENSAKAPTKIITDDLVYFIGFDRSTVSIEIEDTTGCYFARGVGIQKKIDKITRCEIDVLGNVQEIKKRPKQPQPLKMLTDKEKAEKRKNNQNK

SEQ ID NO: 11027 - protein, 165 aa, unidentified
  REGION 1..165: note = Description of Unknown:uncultivated organism sequence
DLYSKDGKYFGVPVYVADLYRGELPKKAATHSKPQNEWRVIDDTYTFEMSIHQDDLLRIESKKGIELKKKKDVENSAKALTKTITDDLVYYIGFNRSKASIEVEDTTGCYNMDGLGIQNIGKITKCEIDVLGNVQEIKKRPKQPQPLKMLTDKERAEKRKNNQNK

SEQ ID NO: 11028 - protein, 165 aa, unidentified
  REGION 1..165: note = Description of Unknown:uncultivated organism sequence
DLYSKDGKYFGVPVYVADLYRGELPRRAATANKPQNEWREMDDTYTFEMSIYQDDLLRIESKKGIELKKKKDVENSAKATSKTITDDFVYFIGFNRATGAMEIEDTSGCYYKDSVGIQNVGKITKCEIDVLGNVQEIKKRPKQPQPLKMLTDKERAEKRKNNQNK

SEQ ID NO: 11029 - protein, 165 aa, unidentified
  REGION 1..165: note = Description of Unknown:uncultivated organism sequence
DLYSKDGKYFGVPVYVADLYRGELPKRAATANKPQNEWREMDDTYTFEMSIYQNDLLRIESKKGIELKKDRNNEFSAKENSILLNDGYVYFTSFCISTAAIKIEDTTGCYVAPSVGIQNLKKITKCEIDVLGNVQEIKKRPKQPQPLKMLTDKEKAEKRKNNQNK

SEQ ID NO: 11030 - protein, 166 aa, unidentified
  REGION 1..166: note = Description of Unknown:uncultivated organism sequence
DLYSKDGKYFGVPVYVADLYRGELPKRAATQKKSQNEWRVMDDTYTFEMSIYQDDLLRIESKKGIELKKKKDVENSAKALTKTITDELVYFIGFDRSTASIEIEDTTGCYFARGVGIQKKIDKITKCEIDVLGNVQEIKKRPKQPQPLKILTDKERAEKRKNKQNK

SEQ ID NO: 11031 - protein, 164 aa, unidentified
  REGION 1..164: note = Description of Unknown:uncultivated organism sequence
DLYSKDGKYFGVPVYVADLYRGELPKRAATANKPQNEWREMDDTYTFEMSIYQDDLLRIESEDGIELKKNKDVENSVKAPTKTITNDLVYYLGFDRDGARIKIEDTTGCYCGRKGIQGIKKITKCEIDVLGNVQEIKKRSKQPQPLKMLTDKERAEKRKKNQNK

SEQ ID NO: 11032 - protein, 165 aa, unidentified
  REGION 1..165: note = Description of Unknown:uncultivated organism sequence
DLYSKDGKYFGVPVYVADLYRGELPKRAATAGKPQNEWRVIDDTYTFEMSIYQDDLLHIESKKGIEFKKNKDVENSAKASTKIIMDDFAYFISFDRATATIKIEDTTGCYFARSIGIQNIGKITKCEIDVLGNVQEIKKRPKQPQPLKMLTDKERAEKRKNNQNK

SEQ ID NO: 11033 - protein, 165 aa, unidentified
  REGION 1..165: note = Description of Unknown:uncultivated organism sequence
DLYSKDGKYFGVPVYVADLYRGELPKRAATNGKPQNEWRVIDDSYTFEMSIYQDDLLRIENKKGIEFKKNKDVENSAKAASKTITDDFVYFIGFDRSTVSIKVEDTTGCYFARGVGIQNIGKITKCEIDVLGNVQEIKKRPKQPQPLKMLTDKEKAEKRKTNQNK

SEQ ID NO: 11034 - protein, 165 aa, unidentified
  REGION 1..165: note = Description of Unknown:uncultivated organism sequence
DLYSKDGKYFGVPVYVADLYRGELPKRAATAGKPQNEWRIMDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 11035 - protein, 165 aa, unidentified
  REGION 1..165: note = Description of Unknown:uncultivated organism sequence
DLYSKDGKYFGVPVYVADLYRGELPKKAATKRKSKNEWRVMDDTYTFEMSIYQDDLLRIESKKGIELKKDRNNEFSAKKNSILLNDGYVYFTSFCISTAAIKIEDTTGCYVAPSVGIQNLKKITKCEIDVLGNVQEIKKRPKQPQPLKMLTDKERAEKRKKNQNK

SEQ ID NO: 11036 - protein, 165 aa, unidentified
  REGION 1..165: note = Description of Unknown:uncultivated organism sequence
DLYSKDGKYFGVPVYVADLYRGELPKRAATANKPQNEWREMDDTYTFEMSIYQDDLLHIENKKGIELKKKKDVENSAKAQTKTITDDLVYFIGFNRSTASIEVEDTTGCYRRDGIGTQNIGKITKCEIDVLGNVQEIKKRPKQPQPLKMLTDKEKAEKRKNNQNK

SEQ ID NO: 11037 - protein, 165 aa, unidentified
  REGION 1..165: note = Description of Unknown:uncultivated organism sequence
DLYSKDGKYFGVPVYVADLYRGELPKRAATNGKSQNEWRVIDDTYTFEMSIYQDDLLRIESKKGIELKKNKDVENSAKATTKTITDDFAYFIGFDRSTASIKIEDTTGCYFAKSIGIQNIGKITKCEIDVLGNVQEIKKRPKQPQPLKMLTDKERAEKRKNNQNK

SEQ ID NO: 11038 - protein, 165 aa, unidentified
  REGION 1..165: note = Description of Unknown:uncultivated organism sequence
DLYSKDGKYFGVPVYVADLYRGELPKKAATHSKPQNEWRVIDDTYTFEMSIYQDDLLRIENKKGIELKKNKDVENSAKAASKTIIDDFVYYIGFDRSTVSIKVEDTTGCYFARGVGIQNIGKITKCEIDVLGNVQEIKKRPKQPQPLKMLTDKERAEKRKNNQNK

SEQ ID NO: 11039 - protein, 164 aa, unidentified
  REGION 1..164: note = Description of Unknown:uncultivated organism sequence
DLYSKDGKYFGVPVYVADLYRGELPKRAATQGKPQNEWRIMDDTYTFEMSIYQDDLLRIESEDGIELKKKKDVENSATAPTKTITNDLVYYLGFDRDGARIKIEDTTGCYCGRKGIQGIKKITKCEIDVLGNVQEIKKRPKQPQPLKMLTDKERAEKRKKNQNK

SEQ ID NO: 11040 - protein, 165 aa, unidentified
  REGION 1..165: note = Description of Unknown:uncultivated organism sequence
DLYSKDGKYFGVPVYVADLYRGELPKRAATANKPQNEWCEMDDTYTFEMSIYQDDLLHIESKKGIELKKKKDVENSAKALTKTITDDLVYFIGFNRSKASIEVEDTTGCYNMDGLGIQNIGKITKCEIDVLGNVQEIKKRPKQPQPLKMLTDKEKAEKRKNNQNK

SEQ ID NO: 11041 - protein, 164 aa, unidentified
  REGION 1..164: note = Description of Unknown:uncultivated organism sequence
DLYSKGGKNYGVPVYVADLYRGELPKKAATKRKSKDEWRVMDDTYTFEMSIYKDDLLRIESEDGIELKKKKDVENSAKAPTKTIMDDFVYFIGFDTDSPRITIEDTTGCYCGRKGIQSIKKITKCEIDVLGNVQEIKKRPKQPQPLKMLTDKERAEKRKNNQNK

SEQ ID NO: 11042 - protein, 166 aa, unidentified
  REGION 1..166: note = Description of Unknown:uncultivated organism sequence
DLYSKDGKYFGVPVYVADLYRGELPKKAATKRKSKNEWRVMDDTYTFEMSIYKDDLLRIESEDGIELKKKKDVENSAKAPTKTIADDFVYFIGFDRSTVSIEIEDTTGCYFARGVGIQKKIDKITRCEIDVLGNVQEIKKRPKQPQPLKILTDKERAEKRKNKQNK

SEQ ID NO: 11043 - protein, 148 aa, unidentified
  REGION 1..148: note = Description of Unknown:uncultivated organism sequence
DIFSKNNNGQKKYYAVPVYLIDVYKGQISTKVCAAGKSVSKWDDISNGYSFEFSLYSGDLFRLKFADKSISGTLQKDGKTKISTQEEYFYYKGFDRSTNTISFKTHDDSLEFRGIGFQSATIFEKYNVDLLGNISRVTSKKREMINKK

SEQ ID NO: 11044 - protein, 165 aa, unidentified
  REGION 1..165: note = Description of Unknown:uncultivated organism sequence
DLYSKDGKYFGVPVYVADLYRGELPKRAATANKPQNEWREMDDTYTFEMSIYQDDLLRIESKKGIELKKKKDVENSAKATSKTITDDFVYFIGFNRATGAMEIEDTSGCYYKDSVGIQNVGKITKCEIDVLGNVQEIKKRLKQPQPLKMLTDKERAEKRKNNQNK

SEQ ID NO: 11045 - protein, 163 aa, unidentified
  REGION 1..163: note = Description of Unknown:uncultivated organism sequence
DLYSKDGKYYGVPVYVADLYKGVLPKRAATAGKPRSEWRLIDDTYTFEMSIYPNDLLRIESNKEIKMTKEYTDEFSPKVNEITFMDNIVYYVKFGISTASITIEDVAGCYLAPSVGIQNLKKITKCEIDVLGNVVEIKNKPKSPQPLKLITEQERREKRKQNK

SEQ ID NO: 11046 - protein, 150 aa, unidentified
  REGION 1..150: note = Description of Unknown:uncultivated organism sequence
DLYSKDGKYYGVPVYTADVYKGVLPNRASTAGKARKDWRVIDDTYTFEMSIYPNDLLHIESKKEITLNKDLKNEFSPKSDEYCFTKGLVYYNMFDISGARFTIEDTTGCYKGRTAIQGLAKITKCEIDVLGNVVEIKNKPKAPQPLCMKK

SEQ ID NO: 11047 - protein, 151 aa, unidentified
  REGION 1..151: note = Description of Unknown:uncultivated organism sequence
DVFVDKDGMNYVVPIYAVDMFSKNLLPDKYVPDDSKVPYDEWPSADIFDFKFSLFKDDLIGINNKMYYVSFFEAATTNVNVKNIDGSMFPDKMDAQDPYTKKICYRPKSKTRKCILKKYSIDTLGNHKEIEQETRLGNDRVKRGKKPKKNG

SEQ ID NO: 11048 - protein, 146 aa, unidentified
  REGION 1..146: note = Description of Unknown:uncultivated organism sequence
DVFADAAGKNYVVPIYSVDIFSNKPLPDKYVPDDNSLTYEQWPRVKESNLKFRFSLFKDDLISVNDKMYYVSFVEAGTVNINVKNIDSSIFPDKKDATDPYTKKIGYRPKSKTKKRVLKKYSVDMLGNYKEIRQEKRLGNRFKSGV

SEQ ID NO: 11049 - protein, 146 aa, unidentified
  REGION 1..146: note = Description of Unknown:uncultivated organism sequence
DVFMDEEGRNYVVPIYSVDIFSKKPPPDKYVPDDYSLSYERWPSVKDDNQKFKFSIFKDDLISLNGKMYYVSFFEASTVNVNVKNVDGSIFPDKKDALDPYTKKICYRPKRKGRKCLLKKYSVDILGNYKEIKQEKRIGNRFKDVV

SEQ ID NO: 11050 - protein, 141 aa, unidentified
  REGION 1..141: note = Description of Unknown:uncultivated organism sequence
DMFVDKDGKNYIVPIYTIDIFSNKPLPEKYLNKNNASYDQWPSINEGKLKFRFSLFKDDLISINNQMYYVDYTRATRSKISIKKVDGSLINKMKGEKTKETGYRNVELKKYSVDMLGKYKEIKQEKRLSNRFEHQNKALQN

SEQ ID NO: 11051 - protein, 134 aa, unidentified
  REGION 1..134: note = Description of Unknown:uncultivated organism sequence
DVFVDEKGKNYVVPIYSVDIFSNKPLPNKYLNKNSAAYRDWPSVKDDNLNFKFSLFKDDLISLDGKMYYVDYVRATRSVISLKKPDGSDFEKTGKNAKEASYRNAELRKYSADLLGNYKEIKQEKRLGNRFGRK

SEQ ID NO: 11052 - protein, 148 aa, unidentified
  REGION 1..148: note = Description of Unknown:uncultivated organism sequence
DIFTDDNGKNYVVPIYATDFFANRPLPDKYVPDDRLMPYEEWPNVVDKTLKFKYSLFKDDLISINGTMYYVSFFEATTTNVNVKNINGSIFIDKKDAQDPYTKKITYRPKKGKCILKKYSIDMLGNYKEIEQEKRVGNIFENGTKRGP

SEQ ID NO: 11053 - protein, 149 aa, unidentified
  REGION 1..149: note = Description of Unknown:uncultivated organism sequence
DVFMDNESKNSVVPIYASDIFANKPLPDKYVPDDRLLPYENWPSVFDKGLKFKFSLFKDDLISIDNKKFKDKKFYVSFFEATTTNVNVKNIDGSIFQDKKNAKDPKTKKITYRPKREKCILKKYTVDMLGNYKEVVQEKRQGNRFENRL

SEQ ID NO: 11054 - protein, 136 aa, unidentified
  REGION 1..136: note = Description of Unknown:uncultivated organism sequence
DVFVDNVGKNYVVPIYSVDIFSNKPLPDKYLHKNDAPYDQWPSVKESKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 11055 - protein, 139 aa, unidentified
  REGION 1..139: note = Description of Unknown:uncultivated organism sequence
DVFTDDEGKNYVVPIYTVDIFNNKPLPDKYLHKNDALYELWPSVTENNLKFKFSLFKDDLISIDGKMFYVNCISGTRSNIEVKNIDGSIFRSTSDREREFGYRNVELKKYSVDMLGNYKEVKQEKRLGNRFENNKKQVI

SEQ ID NO: 11056 - protein, 149 aa, unidentified
  REGION 1..149: note = Description of Unknown:uncultivated organism sequence
DIFTDNESKNYVVPIYATDIFANKPLPDKYVPDNRLLPYEQWPGVFDKGLKFKFSLFKDDLISINDKKFKDKKFYVSFFESTTTNVNVKNIDGSIFPDKKNAIDPKTKKITYRPKRGKCILKKYSVDMLGNFKEVVQEKRQCNRFERRL

SEQ ID NO: 11057 - protein, 136 aa, unidentified
  REGION 1..136: note = Description of Unknown:uncultivated organism sequence
DVFVDNVGKNYVVPIYSVDIFSNKPLPDKYLHKNDAPHDQWPSVKESKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 11058 - protein, 146 aa, unidentified
  REGION 1..146: note = Description of Unknown:uncultivated organism sequence
DIFVDEAGENYVVPIYSTDIFTNKPLPDKYVPHDRTIPYEQWPSIFDNDLKFKFSLFKDDLISINDKMYYVSFFEATTVNVNVKNIDGSVFPNKKNAKDPYTKKIGYRPKSRTKKCVLRKFSVDILGNYKEVKQEKRLGNRFENRN

SEQ ID NO: 11059 - protein, 136 aa, unidentified
  REGION 1..136: note = Description of Unknown:uncultivated organism sequence
DVFVDNVGKNYVVPIYSVDIFSNKPLPDKYLHKNDAPYDQWPSVKEGKLKFKFSLFKDDLISINGQMYYVDYIRATRSKISVKKTDGSFIDNIKEEKTKEIGYKNMELKKYSVDMLGNYKEVKQEKRLGNRFKSGV

SEQ ID NO: 11060 - protein, 146 aa, unidentified
  REGION 1..146: note = Description of Unknown:uncultivated organism sequence
DVFVDEEGRNYVVPIYTVDIFSKKPLPDKYVPDDYSLSYEKWPSIKDDNLKFKFSIFKDDLISINGTMYYVSFFEASTVNVNIKNVDRSIFPDKKDAKDPYTKKICYRPKTRGKKCLLKKYSVDMLGNYKEIRQETRLGNRFKGWV

SEQ ID NO: 11061 - protein, 136 aa, unidentified
  REGION 1..136: note = Description of Unknown:uncultivated organism sequence
DVFVDKDGKNYVVPIYSVDIFSNKPLPDKYLHKNDAPYDQWPSVKEGKLKFKFSLFKDDLISINGQMYYVDYIRATRSKISVKKTDGSFIDNIKEEKTKEVGYKNMELKKYSVDMLGNYKEVKQEKRLGNRFKSGV

SEQ ID NO: 11062 - protein, 146 aa, unidentified
  REGION 1..146: note = Description of Unknown:uncultivated organism sequence
DVFVDEKGHNYMVPIYAVDMACSKPLPDKYLHKNDAPYAEWPSAKDDGLTFRFSLYKDELVSLDGKMYYVAYVRGRRAVIAVKNVDGSPFPNGRTEVEMAYRRAKLAKYCVDVLGSLREVHERRRVGNQFEESKRGRKGQKNEGLG

SEQ ID NO: 11063 - protein, 117 aa, unidentified
  REGION 1..117: note = Description of Unknown:uncultivated organism sequence
DIWANGDKWEGKIVSRFEANTQGTKMTQNILMRLIVGDTICREINGQKEFLRLVKMSLGRITFAPIFEAGALKTRDSDPKDPFKYITMSPNLLKQNKVRLIHVDECGFVYDPGFKEK

SEQ ID NO: 11064 - protein, 136 aa, unidentified
  REGION 1..136: note = Description of Unknown:uncultivated organism sequence
DIYIQKHANGKTSYRMAPVYLHEAANRTRVATQPAEGEHLLCRIHHGDTLRLYLDGVPSYVVVKSFNGQKKSISIAMHHNAARTSGRMLSANIPIEGPSGSCGSRTVAWVFGVAKARIVRIGPLGRYGTINQRSKI

SEQ ID NO: 11065 - protein, 129 aa, unidentified
  REGION 1..129: note = Description of Unknown:uncultivated organism sequence
DIFAGAPGKSGATKWTGRVVSRFDANQQGFEPQARVSTGGEPLIMRLRIDDMLELDDGGGRRIVRVVQLSEGQITLAGDHEAGDLKKRDKDKEDPFKYLRLVPSTLQARNARMVHVSPSGVIRHKGNLS

SEQ ID NO: 11066 - protein, 134 aa, unidentified
  REGION 1..134: note = Description of Unknown:uncultivated organism sequence
DIFTGTPKKSTEGKSTGNKWAGRVISRFAANQPGFQPQARVSTGGEPLIMRLRVNDMLELDHGNERRIMRVVKLSKGQIALARDREAGNLKARDTDKADPFKYLTLSPTGLGTRNARMVHVSPSGVIRHKGNLS

SEQ ID NO: 11067 - protein, 134 aa, unidentified
  REGION 1..134: note = Description of Unknown:uncultivated organism sequence
DIFTGTPKKSTEGKSTGNKWAGRVISRFAANQPGFQPQARVSTGGEPLIMRLRVNDMLELEESDDRWIMRVVKLSKGQITLARDREAGNLKARDADKADPFKYLTLSPAGLGARSARMVRVGPSGVIRHKGNLS

SEQ ID NO: 11068 - protein, 119 aa, unidentified
  REGION 1..119: note = Description of Unknown:uncultivated organism sequence
DFYQSSQGKIKWQIITMFEANDETFVPESDKAGNALLWSAHKDDILLLDDPDNLNYRVRMIVVKIKDGRMGVVKCTDARDAGTRSLYENGLKFFKEKRAQRIITNHLGEPTYFFPMLNE

SEQ ID NO: 11069 - protein, 119 aa, unidentified
  REGION 1..119: note = Description of Unknown:uncultivated organism sequence
DFYKNNKGKIKWQIITMFEANDKTFVPESDKAGNALLWSAHKDDILLMDDPDNLNYRVRMIVVKIQDGRMGVVKCTDARDAGTRSLYENRLKFFKEKRAQRIITNHLGEPTYFFPMLNE

SEQ ID NO: 11070 - protein, 119 aa, unidentified
  REGION 1..119: note = Description of Unknown:uncultivated organism sequence
DFYKNNKGKIKWQIITMFEANDETFVPESDKAGNALLWSAHKDDILLLDDPDNLNYRVRMIVVRISDGKMGVVKCTDAKDAGKRLLYERRLKFFKEKRAQRIITNHLGEPTYFFPMLNE

SEQ ID NO: 11071 - protein, 119 aa, unidentified
  REGION 1..119: note = Description of Unknown:uncultivated organism sequence
DFYQSSQGKINWQIITMFEANDETFVPESDKAGNALLWSAHKDDILLLDDPDNLNYRVRMIVVKISDGKMGVVKCTDAKDAGKRSLYERRLKFFKEKRAQRIITNHLGEPTYFFPMLNE

SEQ ID NO: 11072 - protein, 120 aa, unidentified
  REGION 1..120: note = Description of Unknown:uncultivated organism sequence
DFYQSSQGKIKWQIITMFEANDETFVPESDKAGNALLWSAHKDDILLLDDPDNLNYRVRMIVVKIKDGYMGVVKCTDASEAGNNRSLYEKGLKFFKEKRAQRIITNHLGEPTYFFPMLNE

SEQ ID NO: 11073 - protein, 120 aa, unidentified
  REGION 1..120: note = Description of Unknown:uncultivated organism sequence
DFYQSSQGKINWQIITMFEANDETFVPESDKAGNALLWSAHKDDILLLDDPDNLNYRVRMIVVKIKDGYMGVVKCTDASEAGNNRSLYEKGLKFFKEKRAQRIITNHLGEPTYFFPMLNE

SEQ ID NO: 11074 - protein, 130 aa, unidentified
  REGION 1..130: note = Description of Unknown:uncultivated organism sequence
DIVKTPDGVWRGVGVTRFAANREKLNGGGEPAWKRKYPDARHIMRVHKNDLLKLEKDGIETVMQVVRLNPSSNRFYLVEHFEAGDYPKRHDNDNDDFRWDLASFSGLKDRKARLVHVDPGGGIRDTGPPE

SEQ ID NO: 11075 - protein, 123 aa, unidentified
  REGION 1..123: note = Description of Unknown:uncultivated organism sequence
DIFAGFNGKWTGEVVSTFDANQKIFDPKSRIARNGSPLIMRLRRNDMLAVEEDGQTKIVKAVKISSGKVTFVEHHEANEDKRHRDKEEDFSMTTRGPTALQKMRARIVHVDPAGNIKDPGPPR

SEQ ID NO: 11076 - protein, 131 aa, unidentified
  REGION 1..131: note = Description of Unknown:uncultivated organism sequence
DIYCATKGKDAGKWKCEIISTYSANQKDFVPEWRRRDPHAKLIMKLHINDMVAYDELNKETGQTERVIARVKKMTSGLVYFRSHLIAKEEADKLSKKFSASQMQEKNLRKVYVDAMGKVKDPMFKNERKVS

SEQ ID NO: 11077 - protein, 122 aa, unidentified
  REGION 1..122: note = Description of Unknown:uncultivated organism sequence
DIYKPRNSEKWKFEVINMFAAHKNEMPQWRKDDSRAKLVMRLFKRDTIAYEENGEYRLAVVAGMATHGQISLLPLNVAKVEGNPPKKTPSVLQKLNARKVYVDEIGRVFDPYKRENERMQSC

SEQ ID NO: 11078 - protein, 131 aa, unidentified
  REGION 1..131: note = Description of Unknown:uncultivated organism sequence
DIYCATKGKDAGKWKCEIISTYSANQKDFVPEWRRRDPHAKLIMKLHINDMVAYDELNKGTGQTERVIARVKKMTKGLVFLRGHLIAKEEGDKLSWGASANQMQEKNLRKVYVDAMGKVKDPMFKNERKVS

SEQ ID NO: 11079 - protein, 145 aa, unidentified
  REGION 1..145: note = Description of Unknown:uncultivated organism sequence
DIFEIRSDDKHYPKDAGKWKVDIVSNYMAETNPGVSLWHKKYPTARRIMSLRINDMVMAEFSKDDPQLPSGIRDTVAHQCAVENKDTVNMVFRVKKLNSSGTIYLRPHFIAKEDADTKSWIASTTSLKEHKARKISVSPTGKILK

SEQ ID NO: 11080 - protein, 162 aa, unidentified
  REGION 1..162: note = Description of Unknown:uncultivated organism sequence
DVWFVPEHRSNGKKQSARYQGVFVSRWDALREKLKKVDLSLRKPHPAAKKKGRYYKDDVLYLIPKDKTSEPIWVKVKGFSTTDNKMDIYPIYVSDELVKWVRNVPEPLLPKLPKFLEKYKGYSREKKIPQNFISINVLFQDFEVQKVFVDVDGEVKLPIHKT

SEQ ID NO: 11081 - protein, 121 aa, unidentified
  REGION 1..121: note = Description of Unknown:uncultivated organism sequence
DIWVSEKGKWVGEVISTFDAYQLARKDKKWWKNLIGQNEQKLIMRIRKNDYLQVEHEGEIKTVQIYKFSKGMINMAEHFEANIDARMRAKELKSIQMAPSSLQISKAKRVTVSPSGVINIY

SEQ ID NO: 11082 - protein, 124 aa, unidentified
  REGION 1..124: note = Description of Unknown:uncultivated organism sequence
DIWLNEKGKWEGEVISTFDAYQLSRKDKNWWQKLRGQNEQELIMRIRKNDYLQIEHEGRKKIVQIVKFTNGQFAMAEHFEANVDARTRDKDDDLKFIFKSPSSLQSAKAKRVTISPSGKVNIYQ

SEQ ID NO: 11083 - protein, 122 aa, unidentified
  REGION 1..122: note = Description of Unknown:uncultivated organism sequence
DIWMNEKGKWTGEVISIFEAYQLARKNKNWWQEPVGRNGQKLIMRLRKNDYLQVEHEDKTKIVQVYKFSTAKINMSDHFEANVDARVRIRELKSIQMAPSSLQKSKAKRVTVSPSGVVKIYQ

SEQ ID NO: 11084 - protein, 122 aa, unidentified
  REGION 1..122: note = Description of Unknown:uncultivated organism sequence
DIWVNEKGKWTGEVISTFQAYQLSRKDPKWWQKPVGRNGQKLLMRLRKNDYLQIEHDEKRMIVQVYKFSEGKINMAEHLEANVDARVRAKELKSIQKAPSALQKSKAKRVTVGPSGVVKIYQ

SEQ ID NO: 11085 - protein, 119 aa, unidentified
  REGION 1..119: note = Description of Unknown:uncultivated organism sequence
DIYSPNKGKKAGKWQVEIIPMYYAHQPNFEPEWHKKYPTAKKIMRLFKNDYVAYDEDGERKIRRVKKMNVDGRIFFIDTKIAISDKGINATSVKQLQDRNARKIGVDILGRVYDNKKEK

SEQ ID NO: 11086 - protein, 126 aa, unidentified
  REGION 1..126: note = Description of Unknown:uncultivated organism sequence
DIYCPDKGKKAGKWQIEIIPMFYAHQKDFEPEWHKKYPTAKKIMRLFNNDNVSYIEDGNRIIGRVRKMTGNTVYLRELNIAKKEKGREDIGEQFRPAKLQDMNARKVGIDILGNVFDPQRYEYNRD

SEQ ID NO: 11087 - protein, 126 aa, unidentified
  REGION 1..126: note = Description of Unknown:uncultivated organism sequence
DIYCSDKGKNAGKWQVEIIPMFYAHQQDFEPEWHTKHPTAKKIMRLFINDYVAYDDNENRKIVRVKKMNIDGRLFFIDPTISKSEKDPNATSVKQLQERSARKVGIDILGNVFDPQRHEHNRDKKE

SEQ ID NO: 11088 - protein, 117 aa, unidentified
  REGION 1..117: note = Description of Unknown:uncultivated organism sequence
DIYCPSKGKKADKWQVDIIPMFKAHQSNFEPEWHKQNPTAKKVMRLFINDYVAFDEDGERKIRRVRKMTGNIVYLRELNIALKEKGKEDIGEQFRPSTFQAKNARKIGIDILGNVCD

SEQ ID NO: 11089 - protein, 158 aa, unidentified
  REGION 1..158: note = Description of Unknown:uncultivated organism sequence
EVYQINSQNKINGCLTKDQGDWKTEIVSNYNATIRHGRGENIAYWHYKYPNAKRIMTLRRNDMVLGTFTREQASQSTFPKGLTEYVQNIFNQDTCLDQVDVLLRVKKISSDGRIALTPHNIAKEDHDTKSWLANADALKTYNARKVFVTSMGKIRHAK

SEQ ID NO: 11090 - protein, 145 aa, unidentified
  REGION 1..145: note = Description of Unknown:uncultivated organism sequence
DIFEIRSDDRRYPALAGQWQSEIISNYCATLNNGTPMWRCKYATARRVMRLRINDMVMAEFSRDNVPLLKGLEDAVRHQLAVQDTDTVNIIFRVKKISSNGAIFLRPHYIAKEDADTKTWQANATSLQKYKARKIRVSPTGKVLE

SEQ ID NO: 11091 - protein, 117 aa, unidentified
  REGION 1..117: note = Description of Unknown:uncultivated organism sequence
DIWSNGDKWEGKIISRFEANSKNFNKKQNCLMRLFVGDTLCCELNEQKKFYHILGITDGKVTLAEIHEAGNLKERDRDKKDYFKYIFKAPSKLKDFKARLVHVDECGFVYDPEFKEK

SEQ ID NO: 11092 - protein, 117 aa, unidentified
  REGION 1..117: note = Description of Unknown:uncultivated organism sequence
DIYANGDKWEGKIISRFDANSQSPTKTNNIIMSLFIGDTLCCEKDGKRILYHILGITDQKITMAELFEAGNLKERDKNKNDYFKYTYKKASTLKPLKARIVHVDECGFVYDPGFKEK

SEQ ID NO: 11093 - protein, 117 aa, unidentified
  REGION 1..117: note = Description of Unknown:uncultivated organism sequence
DIWANGDKWEGKIVSRFEANTRGAKKPQNLLMRIFVGDTLCCETENKKILYHVLAITDGMITMVEPYEAGNLRERSRSKTDYLKYTFKSPNALKPIKTRIVHVDECGFVYDPGFKEK

SEQ ID NO: 11094 - protein, 129 aa, unidentified
  REGION 1..129: note = Description of Unknown:uncultivated organism sequence
EIFEAENDKWDGRIISRFQANSNEYRAFANSKEFHHVSFNGEQLVMRLMANDCVVLGEDSTVYRVQKISAGVIVMAPANEGNVDARSRDKDDPFSFISRAPNRLKQTGARRVFVDVIGSVKDPGEKIPE

SEQ ID NO: 11095 - protein, 122 aa, unidentified
  REGION 1..122: note = Description of Unknown:uncultivated organism sequence
DIYCPNKGEKAGKWHVEIIPMFHAHQPDFEPQWHKQNPTAKKIMRLFINDFVSYNENDERKIRRVKKLSVDGRLFFIDPKIAKSDKEPNATSVKQLQERNARKIGVDILGKVYDPKQKNENH

SEQ ID NO: 11096 - protein, 122 aa, unidentified
  REGION 1..122: note = Description of Unknown:uncultivated organism sequence
DIWVDPKGKWTGEVVSTFQAYQLAREDKDWWTKQTGRAGQPLAMRIRKGDMVKVIVDGKPLILTVYKFSEGKLNMAEHNEANASARIREKTLNGFQMSPSSLQKADAKRITVSPSGMVKIYQ

SEQ ID NO: 11097 - protein, 126 aa, unidentified
  REGION 1..126: note = Description of Unknown:uncultivated organism sequence
DVVKTADGRWHGLGLSVFDANQKNPGEHWKVQFPDALHVMRLHKNDQIKLVCDGTEKIMRIIRLVPSDHRVFLAGHCDGGVLQKRHEDADDFFRWDWPTFDALKARRARLVHVTSSGRVFDPGPIS

SEQ ID NO: 11098 - protein, 127 aa, unidentified
  REGION 1..127: note = Description of Unknown:uncultivated organism sequence
DIWMSEKGKWTGEVISTYQAYQLARTDENWWQTLEGQDGQKLLMRLRKNDYLQIIHNDRQLIVQISQLTQGQIALAEHIEANVDARTRDKNDPLKFIFKSPGSLQKANTKYVTVSPSGVLNIHATGA

SEQ ID NO: 11099 - protein, 188 aa, unidentified
  REGION 1..188: note = Description of Unknown:uncultivated organism sequence
RLFAWRGRRGAIEMGMVRVFTAELPYILKNSTHGDVLTATIPASTFSFRNTPATLRKKLLAGEAVSVGWLTQNDEIEIEVDEFACGNTSFAKFLTEIPEKRWRVDGFYDNRRLRIRPAYLSAEGLTDNHSKVVHETLEKGQFVNAGALLSASRTLLIRRTALGAPRWKLDSSGLPVSFSPLKLAEEAL

SEQ ID NO: 11100 - protein, 206 aa, unidentified
  REGION 1..206: note = Description of Unknown:uncultivated organism sequence
RLYSWLTKKGDLKVNVLRVYGAEFPWLMRESGSSDVLRMPIHPGSQSFRDVQEETIEMIEGGFAKEIAWITQNDELEFDPVEYINLPGRSDKLTRFLIYMPETRWRVDGFPESRNLRIRPLMLSQEDLPSEIKKHKEEKQLSDEEKLLVEALEKGLIITSSKLLGLKSIKVIRRNNLGFPRWRGNGNLPTSFEVRSSALRALGVEG

SEQ ID NO: 11101 - protein, 202 aa, unidentified
  REGION 1..202: note = Description of Unknown:uncultivated organism sequence
RLYAWKNRKGKAEVGMLRVFGAEFPWLMRESGVKDVLRVPIHTGSQSYRDLSDTVCKHIEQGVAQEIGWVTQNDELEFDPDDYLQNGGKDKLAKFLSFMPENRWRIDGFQTSTKLRIRPALLSWEELPTRLYGKELAENQYALLEESLKTGLIIATKGLLSLESSKIIRRNNLGIPRWRGSSYRPVSLDIQRAALAALDEQE

SEQ ID NO: 11102 - protein, 202 aa, unidentified
  REGION 1..202: note = Description of Unknown:uncultivated organism sequence
RLYAWKNQRGDIQVGMLRVFGAEFPWFMRESDVKDILRVPIPQGSQSYRDLAATTRKFIENGQATEFGWITQNDEIEISAEEYLATDKGDILSDFLGVLPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 11103 - protein, 198 aa, unidentified
  REGION 1..198: note = Description of Unknown:uncultivated organism sequence
RLYAWKNRKGKAEVGMLRVFGAEFPWLMRESGVKDVLRVPIHTGSQSYRDLSFTVRKNIEKGEAVEIGWLTQNEELEFNPESYLQEGGKDKLAKFLAFLPETRWRVDGFPMPDKLRIRPALLSREEIPEGVFGTEEQSLLEEALTKGLIIATKGLLSLPDVKVLRRNNLGIPRWRGGSYRPVSLDIQRAALAALDEQE

SEQ ID NO: 11104 - protein, 202 aa, unidentified
  REGION 1..202: note = Description of Unknown:uncultivated organism sequence
RLYGWKNQRGDIQVGMLRVFGAEFPWFMRESGVKDILRVPIPQGSQSYRDLAATTRKFIENGQATEFGWITQNDEIEISAEEYLATDKGDILSDFLGVLPEIRWKVTGIEDNRRIRLRPLLLSSEAIPNMLNGRLLTQEEHDLIALVINKGVRVVVSTFLALPSTKIIRRNNLGIPRWRGNGHLPTSLDIQRAATQALEGRD

SEQ ID NO: 11105 - protein, 198 aa, unidentified
  REGION 1..198: note = Description of Unknown:uncultivated organism sequence
RLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGSSYRPVSLDIQRAALAALDEQE

SEQ ID NO: 11106 - protein, 198 aa, unidentified
  REGION 1..198: note = Description of Unknown:uncultivated organism sequence
RLYAWKNRKGKAEVGMLRVFGAEFPWLMRESGVKDVLRVPIHTGSQSYRDLSFTVRKNIEKGEAAEIGWLTQNEELEFNPESYLQEGGKDKLAKFLAFLPETRWRVDGFPMPDKLRIRPALLSREEIPEGVFRTEEQSLLEEALTKGLIIATKGLLSLPDVKVLRRNNLGIPRWRGGSYRPVSLDIQRAALAALEEQE

SEQ ID NO: 11107 - protein, 191 aa, unidentified
  REGION 1..191: note = Description of Unknown:uncultivated organism sequence
RILTWDDPKKGPQLGIQRVFAAELGEMLKDASSNDLFEAPIPFHTMSHRDLQPQVRAAVEQGLTRQIGWITLGDEIEIDPSDFAEDTTKFGKFLREFPERNWSIAGLKESRKLVLRPLMLSAEGASPANSSLTAEVLDGGVKVHPSTLLASPGTTIIRRTGLGRPRWDSGLAHLPESFNVHARMTQQSARD

SEQ ID NO: 11108-11129 - skipped (22 entries)

SEQ ID NO: 11130 - RNA, 119 nt, synthetic construct
  misc_feature 1..119: note = Description of Artificial Sequence: Syntheticpolynucleotide
  source 1..119: mol_type = other RNA
nnnnnnnnnnnnnnnnnnnngttttgatttactcgaaagagtccaatcataattgaccggagaataattgattcctctacaatgtacgaataaattcattctctaaaccttaaaaattt

SEQ ID NO: 11131 - RNA, 101 nt, synthetic construct
  misc_feature 1..101: note = Description of Artificial Sequence: Syntheticpolynucleotide
  source 1..101: mol_type = other RNA
nnnnnnnnnnnnnnnnnnnnnnnngtttcaatgaaaattgaaataagcggtttcgtaccgtgaattctccagcccctcggtttaccggggggcttcgtttt

SEQ ID NO: 11132 - RNA, 118 nt, synthetic construct
  misc_feature 1..118: note = Description of Artificial Sequence: Syntheticpolynucleotide
  source 1..118: mol_type = other RNA
nnnnnnnnnnnnnnnnnnnnnnnngccctagcggggtgcagaaatgcaccgcgtttgggtaagagggttcgcctttgtggcggaccactcgtggggtacaccctgcgctccatctttt

SEQ ID NO: 11133 - RNA, 116 nt, synthetic construct
  misc_feature 1..116: note = Description of Artificial Sequence: Syntheticpolynucleotide
  source 1..116: mol_type = other RNA
nnnnnnnnnnnnnnnnnnnngtcttgccggaaacggctagacaagggaatcgcttttacgcgattacccgcaaggtaagcccgtcagcacccttggtgtcggcgggcgatcctttt

SEQ ID NO: 11134 - RNA, 120 nt, synthetic construct
  misc_feature 1..120: note = Description of Artificial Sequence: Syntheticpolynucleotide
  source 1..120: mol_type = other RNA
nnnnnnnnnnnnnnnnnnnngtcttggcggaaacgcctagacaagaggaccgaggaacatatccctggttactcgcaaggttaacccgctaaggacattgttcttggcgggcgatccttt

SEQ ID NO: 11135 - RNA, 117 nt, synthetic construct
  misc_feature 1..117: note = Description of Artificial Sequence: Syntheticpolynucleotide
  source 1..117: mol_type = other RNA
nnnnnnnnnnnnnnnnnnnngtcttgccggaaacggctagacaagggaatcgctttatgcggttacccgcaaggtactcgcccgttggcagctttactgctgacgggcgatcctttt

SEQ ID NO: 11136 - RNA, 111 nt, synthetic construct
  misc_feature 1..111: note = Description of Artificial Sequence: Syntheticpolynucleotide
  source 1..111: mol_type = other RNA
nnnnnnnnnnnnnnnnnnnngtcttcgcggaaatgcgtagacaaggggaccacttagtggttacccgcaaggtgagcccgctgatgattcatcatcggcgggcgatccttt

SEQ ID NO: 11137 - RNA, 136 nt, synthetic construct
  misc_feature 1..136: note = Description of Artificial Sequence: Syntheticpolynucleotide
  source 1..136: mol_type = other RNA
nnnnnnnnnnnnnnnnnnnnnnnngttgtgattagcgaaagctaatcacaaaaagggtttttcccgttgtgaaatcgcattgggttcttcgtcccttaattcggagaaatttaagcacggcgtaagtcgtgctttt

SEQ ID NO: 11138 - RNA, 125 nt, synthetic construct
  misc_feature 1..125: note = Description of Artificial Sequence: Syntheticpolynucleotide
  source 1..125: mol_type = other RNA
nnnnnnnnnnnnnnnnnnnngccgtggttgacctcgaaagaggtcagccacggtaagatcaaatcttaagtggtttgaacccgcaaagtaaccctcggggggcaacccccggggggatcttcttt

SEQ ID NO: 11139 - RNA, 131 nt, synthetic construct
  misc_feature 1..131: note = Description of Artificial Sequence: Syntheticpolynucleotide
  source 1..131: mol_type = other RNA
nnnnnnnnnnnnnnnnnnnnnnnngttgtagttccctggaaacaggttactgcaataaggttgccacgagaatgtggtatgccgcaagctctgccccagccgtcaaacgtgctggggtattcttgtatcta

SEQ ID NO: 11140 - RNA, 115 nt, synthetic construct
  misc_feature 1..115: note = Description of Artificial Sequence: Syntheticpolynucleotide
  source 1..115: mol_type = other RNA
nnnnnnnnnnnnnnnnnnnngtttgagaacctgaaaaggtgagtgcaaataaggttttaaccgacattgtttacgcacattggtgctataaaaaaggctttttaagccttttttt

SEQ ID NO: 11141 - RNA, 147 nt, synthetic construct
  misc_feature 1..147: note = Description of Artificial Sequence: Syntheticpolynucleotide
  source 1..147: mol_type = other RNA
nnnnnnnnnnnnnnnnnnnnnnnngttttagttctctgatgaaaatcaattagttctaagataaggcattatgccgcggggtatggcggtatcctcacaagcaatccgccaacttaaaaagtcagcgcgtttatgaaacgcgctttt

SEQ ID NO: 11142 - RNA, 136 nt, synthetic construct
  misc_feature 1..136: note = Description of Artificial Sequence: Syntheticpolynucleotide
  source 1..136: mol_type = other RNA
nnnnnnnnnnnnnnnnnnnngttgcggattgacagaaatgtctggggttcgccccgttgcgtcgcaagacgcatatccgttaacaaggattttaatccaccaaataagagaccgaacttttgttcggtctcgtttt

SEQ ID NO: 11143 - RNA, 107 nt, synthetic construct
  misc_feature 1..107: note = Description of Artificial Sequence: Syntheticpolynucleotide
  source 1..107: mol_type = other RNA
nnnnnnnnnnnnnnnnnnnngttgcggattgacttgaaaaagttgtccgttaacaaggaatttatttccaccaaataagggcgatgcttttgcatcgcctctttttg

SEQ ID NO: 11144 - RNA, 134 nt, synthetic construct
  misc_feature 1..134: note = Description of Artificial Sequence: Syntheticpolynucleotide
  source 1..134: mol_type = other RNA
nnnnnnnnnnnnnnnnnnnngtttgagagtgatgtagaaatacatcacgagttcaaaaaacatgatttattcaaatcgtcttcttcagaagaccccacagtgtgtggaactaaagcttgcttcggcaggctttt

SEQ ID NO: 11145 - RNA, 127 nt, synthetic construct
  misc_feature 1..127: note = Description of Artificial Sequence: Syntheticpolynucleotide
  source 1..127: mol_type = other RNA
nnnnnnnnnnnnnnnnnnnngtttgagagtgagaaatcacgagttcaaaaaacatgatttattcaaaccgtcttcttcggaaggccccacagtgtgtggacagtaaagcttgcttcggcaagctttt

SEQ ID NO: 11146 - RNA, 177 nt, synthetic construct
  misc_feature 1..177: note = Description of Artificial Sequence: Syntheticpolynucleotide
  source 1..177: mol_type = other RNA
nnnnnnnnnnnnnnnnnnnnttttttttttttttttttttttttttttttttttttttttcaaggttcaagatatctccagtcatagttcccttgaaaaaggttactatgacaaggctacgcagatgtgcgtacgccgcaagtatcccattcattcttcttgagtgagtgggatttt

SEQ ID NO: 11147 - RNA, 177 nt, synthetic construct
  misc_feature 1..177: note = Description of Artificial Sequence: Syntheticpolynucleotide
  source 1..177: mol_type = other RNA
nnnnnnnnnnnnnnnnnnnnttttttttttttttttttttttttttttttttttttttttcaaggttcaagatatctccagtcatatttcccttgaaaaaggttaatgtgacaaggctgcgcattcgtgcgtatgccgaacctatcccattcattcgttatgagtgaatgggatttt

SEQ ID NO: 11148 - RNA, 128 nt, synthetic construct
  misc_feature 1..128: note = Description of Artificial Sequence: Syntheticpolynucleotide
  source 1..128: mol_type = other RNA
nnnnnnnnnnnnnnnnnnnnnnnnagccaccacgtcgcaagcctcgacgttgcgacttgactgaaaagtcagtcgttaataagaattttttcgtatttgtaggataagagttcgcctcttatcctttt

SEQ ID NO: 11149 - RNA, 136 nt, synthetic construct
  misc_feature 1..136: note = Description of Artificial Sequence: Syntheticpolynucleotide
  source 1..136: mol_type = other RNA
nnnnnnnnnnnnnnnnnnnnnnnnagccaccacgtcgcaagcctcgacgttgcgacttgactgaaaagttagtcgttaataagatttttttcgtacattaaaggaataaaagttcgccttttattccttatttttt

SEQ ID NO: 11150 - RNA, 146 nt, synthetic construct
  misc_feature 1..146: note = Description of Artificial Sequence: Syntheticpolynucleotide
  source 1..146: mol_type = other RNA
nnnnnnnnnnnnnnnnnnnnnnnnagccaccacgtcgcaagcctcgacgttgtggtttgctttcaaagaaatttgttagcttatcacaataaaagattattctgtaggtctttttagacctatgccccgcttattgcggggctttt

SEQ ID NO: 11151 - RNA, 128 nt, synthetic construct
  misc_feature 1..128: note = Description of Artificial Sequence: Syntheticpolynucleotide
  source 1..128: mol_type = other RNA
nnnnnnnnnnnnnnnnnnnngttttggctctctgatgaaaatcagagttctaagataaggcaatatgccgtagggtagtggaaacccctttgcaccatatattaaagacaaccttagggttgtctttt

SEQ ID NO: 11152 - RNA, 120 nt, synthetic construct
  misc_feature 1..120: note = Description of Artificial Sequence: Syntheticpolynucleotide
  source 1..120: mol_type = other RNA
nnnnnnnnnnnnnnnnnnnngttttggctctcgaaagagttctaagataaggcaatatgccgtagggtagtggaaaccccttcgcaccatatattaaagacaaccttagggttgtctttt

SEQ ID NO: 11153 - RNA, 147 nt, synthetic construct
  misc_feature 1..147: note = Description of Artificial Sequence: Syntheticpolynucleotide
  source 1..147: mol_type = other RNA
nnnnnnnnnnnnnnnnnnnnnnnngttttagttctctgatgaaaatcagtaagttctaaaataaggcattatgccgtggggtatggtggtatcctcgttcaaatatccaccgtttctaaaaaaatcgcgcgccgccggcgtgctttt

SEQ ID NO: 11154 - RNA, 127 nt, synthetic construct
  misc_feature 1..127: note = Description of Artificial Sequence: Syntheticpolynucleotide
  source 1..127: mol_type = other RNA
nnnnnnnnnnnnnnnnnnnnnnnngttgtggcttgctgacgaagaaattcgaatagcttgtcacaataaggccattaaggccgaaggttgtaaaacctatggctcgacttcggttgagccttctttt

SEQ ID NO: 11155 - RNA, 111 nt, synthetic construct
  misc_feature 1..111: note = Description of Artificial Sequence: Syntheticpolynucleotide
  source 1..111: mol_type = other RNA
nnnnnnnnnnnnnnnnnnnnnnnngttgtggcttgcttgaaaaagcttgtcacaataaggtcgtcatgaccgaaggcttaatgcctatagcccgacttcggttgggctttt

SEQ ID NO: 11156 - RNA, 118 nt, synthetic construct
  misc_feature 1..118: note = Description of Artificial Sequence: Syntheticpolynucleotide
  source 1..118: mol_type = other RNA
nnnnnnnnnnnnnnnnnnnnnnnngttttagttcccttttgaaaaaaaggttactgaaataagggatttttcccgtaaagctctgtccccgcggaaattttccacggggatatctttt

SEQ ID NO: 11157 - RNA, 114 nt, synthetic construct
  misc_feature 1..114: note = Description of Artificial Sequence: Syntheticpolynucleotide
  source 1..114: mol_type = other RNA
nnnnnnnnnnnnnnnnnnnnnnnngttttagttcccttgaaaaaggtttctaaaacaagggttaattcccgaaaagctctatcccttgatgattttcatcaagggatatctttt

SEQ ID NO: 11158 - RNA, 98 nt, synthetic construct
  misc_feature 1..98: note = Description of Artificial Sequence: Syntheticoligonucleotide
  source 1..98: mol_type = other RNA
nnnnnnnnnnnnnnnnnnnngttctggcgaagaaattcgccagtaataagctgaaaaactagcactaaatagggttcccgcaagggaaccctcgtttt

SEQ ID NO: 11159 - RNA, 76 nt, synthetic construct
  misc_feature 1..76: note = Description of Artificial Sequence: Syntheticoligonucleotide
  source 1..76: mol_type = other RNA
ggaatcaaggacaaaattagtggctcaaatttgaacactgcgcgttcatacggcacttcaaatatgaaagagtttt

SEQ ID NO: 11160 - RNA, 79 nt, synthetic construct
  misc_feature 1..79: note = Description of Artificial Sequence: Syntheticoligonucleotide
  source 1..79: mol_type = other RNA
tcttgggagagacattgaaataagcggtttcgtaccgtgaattctccagcccctcggtttaccggggggcttcgttttt

SEQ ID NO: 11161 - RNA, 82 nt, synthetic construct
  misc_feature 1..82: note = Description of Artificial Sequence: Syntheticoligonucleotide
  source 1..82: mol_type = other RNA
taacgaaagattcttaataaggcgtccttccgatgctgacttctcaccgtccgttttccaataggagcgggcggtatgtttt

SEQ ID NO: 11162 - RNA, 80 nt, synthetic construct
  misc_feature 1..80: note = Description of Artificial Sequence: Syntheticoligonucleotide
  source 1..80: mol_type = other RNA
agtgacgattctcaacaaaagacttttgtcttgatttctttatcccccggcattttgtgccgggggattcgttattcaaa

SEQ ID NO: 11163 - RNA, 90 nt, synthetic construct
  misc_feature 1..90: note = Description of Artificial Sequence: Syntheticoligonucleotide
  source 1..90: mol_type = other RNA
taacagctaaatgatatgcaccgcgtttgggtaagagggttcgcctttgtggcggaccactcgtggggtacaccctgcgctccatctttt

SEQ ID NO: 11164 - RNA, 113 nt, synthetic construct
  misc_feature 1..113: note = Description of Artificial Sequence: Syntheticpolynucleotide
  source 1..113: mol_type = other RNA
ttgtatcaactggggagttggaaggaatcacggctagacaagggaatcgcttttacgcgattacccgcaaggtaagcccgtcagcacccttggtgtcggcgggcgatcctttt

SEQ ID NO: 11165 - RNA, 117 nt, synthetic construct
  misc_feature 1..117: note = Description of Artificial Sequence: Syntheticpolynucleotide
  source 1..117: mol_type = other RNA
ttgtactaactggggagttggaaggacatacgcctagacaagaggaccgaggaacatatccctggttactcgcaaggttaacccgctaaggacattgttcttggcgggcgatccttt

SEQ ID NO: 11166 - RNA, 112 nt, synthetic construct
  misc_feature 1..112: note = Description of Artificial Sequence: Syntheticpolynucleotide
  source 1..112: mol_type = other RNA
gtaccaattggggaattggaaggatcaacggctagacaagggaatcgctttatgcggttacccgcaaggtactcgcccgttggcagctttactgctgacgggcgatcctttt

SEQ ID NO: 11167 - RNA, 103 nt, synthetic construct
  misc_feature 1..103: note = Description of Artificial Sequence: Syntheticpolynucleotide
  source 1..103: mol_type = other RNA
tgtaccaactggggagttgagatcatgcgtagacaaggggaccacttagtggttacccgcaaggtgagcccgctgatgattcatcatcggcgggcgatccttt

SEQ ID NO: 11168 - RNA, 105 nt, synthetic construct
  misc_feature 1..105: note = Description of Artificial Sequence: Syntheticpolynucleotide
  source 1..105: mol_type = other RNA
attatatcatagcgaggtatttcaggttcctgcaataaggtctagctgttatgctagtaccgcaaagctctggcggcttaccttcatggtaggtcgccatctttt

SEQ ID NO: 11169 - RNA, 105 nt, synthetic construct
  misc_feature 1..105: note = Description of Artificial Sequence: Syntheticpolynucleotide
  source 1..105: mol_type = other RNA
attatatcttagcgagagatatcaggttattacaataaggtccaacaggactgttggtaccgtaaagatctaacggtgcgcctttgggcgcaccgttagagtttt

SEQ ID NO: 11170 - RNA, 106 nt, synthetic construct
  misc_feature 1..106: note = Description of Artificial Sequence: Syntheticpolynucleotide
  source 1..106: mol_type = other RNA
ttatatctttgagagagatgataggttgttacaataaggtccggcaggagtgccggtaccgtaaagctctaacggcgtgcctattattaggtacgccgttatcttt

SEQ ID NO: 11171 - RNA, 102 nt, synthetic construct
  misc_feature 1..102: note = Description of Artificial Sequence: Syntheticpolynucleotide
  source 1..102: mol_type = other RNA
attatatcttagcgagagatattaggttattacaataaggtccaacgtagttggtaccgcaaagctctaacggtatgccttttggcataccgttatcttttt

SEQ ID NO: 11172 - RNA, 104 nt, synthetic construct
  misc_feature 1..104: note = Description of Artificial Sequence: Syntheticpolynucleotide
  source 1..104: mol_type = other RNA
attatatcttagcgagggatattaggttattacaataaggtccaacaggagtgttggtaccgcaaagctctaacggtacgcctattggcgtaccgttatctttt

SEQ ID NO: 11173 - RNA, 79 nt, synthetic construct
  misc_feature 1..79: note = Description of Artificial Sequence: Syntheticoligonucleotide
  source 1..79: mol_type = other RNA
cataatttaagcaattcacaataaggattattccgttgtgaaaacatttaaagcggggtcaacagcctcgctttctttt

SEQ ID NO: 11174 - RNA, 110 nt, synthetic construct
  misc_feature 1..110: note = Description of Artificial Sequence: Syntheticpolynucleotide
  source 1..110: mol_type = other RNA
ctgctaatttgaaagctaatcacaaaaagggtttttcccgttgtgaaatcgcattgggttcttcgtcccttaattcggagaaatttaagcacggcgtaagtcgtgctttt

SEQ ID NO: 11175 - RNA, 97 nt, synthetic construct
  misc_feature 1..97: note = Description of Artificial Sequence: Syntheticoligonucleotide
  source 1..97: mol_type = other RNA
cctgaaactaggaggtcagccacggtaagatcaaatcttaagtggtttgaacccgcaaagtaaccctcggggggcaacccccggggggatcttcttt

SEQ ID NO: 11176 - RNA, 111 nt, synthetic construct
  misc_feature 1..111: note = Description of Artificial Sequence: Syntheticpolynucleotide
  source 1..111: mol_type = other RNA
attatatcatatcaaagtagaataggttattacaataagacctggattttattgtaaaatctatgagtcgtaaagctctagctgtcctctaaagggcagctatcttcatat

SEQ ID NO: 11177 - RNA, 134 nt, synthetic construct
  misc_feature 1..134: note = Description of Artificial Sequence: Syntheticpolynucleotide
  source 1..134: mol_type = other RNA
tcgtagtaaacaccattttctctcgtagtggcataagccgcttttattatagcatattgtcaggttctgtcaagagattttaaaaatattacacgacaattgtgcagcgtgacaattgcataagtaaatgtttt

SEQ ID NO: 11178 - RNA, 110 nt, synthetic construct
  misc_feature 1..110: note = Description of Artificial Sequence: Syntheticpolynucleotide
  source 1..110: mol_type = other RNA
ttataccactacgagaaaatacaggttactgcaataaggttgccacgagaatgtggtatgccgcaagctctgccccagccgtcaaacgtgctggggtattcttgtatcta

SEQ ID NO: 11179 - RNA, 96 nt, synthetic construct
  misc_feature 1..96: note = Description of Artificial Sequence: Syntheticoligonucleotide
  source 1..96: mol_type = other RNA
caaatttgaaagcaattcacaataaggattattccgttgtgaaaacatttaaagcggctttacagcacattgtgtttgtgaagtcgttttcttttt

SEQ ID NO: 11180 - RNA, 91 nt, synthetic construct
  misc_feature 1..91: note = Description of Artificial Sequence: Syntheticoligonucleotide
  source 1..91: mol_type = other RNA
ttgctaattgaaagcaattcgcaataaggattattccgttgtgaaaacatttcgagtggcttcgtgaatattcacgaagtcacttcgtttt

SEQ ID NO: 11181 - RNA, 86 nt, synthetic construct
  misc_feature 1..86: note = Description of Artificial Sequence: Syntheticoligonucleotide
  source 1..86: mol_type = other RNA
acttacaaggtgagtgcaaataaggttttaaccgacattgtttacgcacattggtgctataaaaaaggctttttaagccttttttt

SEQ ID NO: 11182 - RNA, 69 nt, synthetic construct
  misc_feature 1..69: note = Description of Artificial Sequence: Syntheticoligonucleotide
  source 1..69: mol_type = other RNA
acttacaaggtgagtgcaaataaggctttagccgacatcgtttacctgcattgtgcagtgacttttttt

SEQ ID NO: 11183 - RNA, 89 nt, synthetic construct
  misc_feature 1..89: note = Description of Artificial Sequence: Syntheticoligonucleotide
  source 1..89: mol_type = other RNA
atatctgatttggaaaggaagctataataatcgaaaaatttcgagtggggctctgacgaactgttttttggcagtagtcatcccctttt

SEQ ID NO: 11184 - RNA, 82 nt, synthetic construct
  misc_feature 1..82: note = Description of Artificial Sequence: Syntheticoligonucleotide
  source 1..82: mol_type = other RNA
atagtatatctgatttggaaagcaagctataataatcgagaaatttcgagtggggctctgatgcttggcatcatcccctttt

SEQ ID NO: 11185 - RNA, 101 nt, synthetic construct
  misc_feature 1..101: note = Description of Artificial Sequence: Syntheticpolynucleotide
  source 1..101: mol_type = other RNA
gacgatttgagaagcaaccgtttatataataaagaatattttctgtggggttttacgattatgtatcccctgatgccgtccccaaaacggggacggctttt

SEQ ID NO: 11186 - RNA, 100 nt, synthetic construct
  misc_feature 1..100: note = Description of Artificial Sequence: Syntheticpolynucleotide
  source 1..100: mol_type = other RNA
gacgatttgagaagcaaccgtttatataataaagaatattttctgtggggttttacgattacgtatcccctgcgccgtcccccaacgggggacggctttt

SEQ ID NO: 11187 - RNA, 98 nt, synthetic construct
  misc_feature 1..98: note = Description of Artificial Sequence: Syntheticoligonucleotide
  source 1..98: mol_type = other RNA
gacgatttgagaagcaaccgtttatataataaagaatattttctgtggggttctacgattatgtatcccctgaaaccgtccccctgcggggacggttt

SEQ ID NO: 11188 - RNA, 98 nt, synthetic construct
  misc_feature 1..98: note = Description of Artificial Sequence: Syntheticoligonucleotide
  source 1..98: mol_type = other RNA
gacgatttgagaagcaaccgtttatataataaagaatattttctgtggggttctacgattatgtatcccctgaagccgtccccctgcggggacggttt

SEQ ID NO: 11189 - RNA, 123 nt, synthetic construct
  misc_feature 1..123: note = Description of Artificial Sequence: Syntheticpolynucleotide
  source 1..123: mol_type = other RNA
gtgtaagtttatcaatatccatcaattagttctaagataaggcattatgccgcggggtatggcggtatcctcacaagcaatccgccaacttaaaaagtcagcgcgtttatgaaacgcgctttt

SEQ ID NO: 11190 - RNA, 67 nt, synthetic construct
  misc_feature 1..67: note = Description of Artificial Sequence: Syntheticoligonucleotide
  source 1..67: mol_type = other RNA
acaaggcaagttcaaataaaacttttgtctaatcacttttcgcaggtgcgaacactaacgctctttt

SEQ ID NO: 11191 - RNA, 98 nt, synthetic construct
  misc_feature 1..98: note = Description of Artificial Sequence: Syntheticoligonucleotide
  source 1..98: mol_type = other RNA
tcattaccctatagatttacactgcaagttcaaataatattattatgaatgcgtcagataactgacaaacacagtgcgtgttataaaaagtctatttt

SEQ ID NO: 11192 - RNA, 83 nt, synthetic construct
  misc_feature 1..83: note = Description of Artificial Sequence: Syntheticoligonucleotide
  source 1..83: mol_type = other RNA
tttagcacatcagaaattcacagaatctatcagaacaagactttatgtcgaaatcacattttcgtttgaaaatggttaatttt

SEQ ID NO: 11193 - RNA, 107 nt, synthetic construct
  misc_feature 1..107: note = Description of Artificial Sequence: Syntheticpolynucleotide
  source 1..107: mol_type = other RNA
tttattgcattaagaatttacaaatcctactaaaataagactttatgtcgagttcacattctgtgaagaatggaaatttaattatttatgccataaatggacctttt

SEQ ID NO: 11194 - RNA, 131 nt, synthetic construct
  misc_feature 1..131: note = Description of Artificial Sequence: Syntheticpolynucleotide
  source 1..131: mol_type = other RNA
aatgtagaaatcaaagaacgggctcgaaaatggcaaatcattttcggactttaattaaatttaaagttgtccgttaacaaggaatttatttccaccaaataagggcgatgcttttgcatcgcctctttttg

SEQ ID NO: 11195 - RNA, 96 nt, synthetic construct
  misc_feature 1..96: note = Description of Artificial Sequence: Syntheticoligonucleotide
  source 1..96: mol_type = other RNA
ttatactataccaaaagtaaataggttactgcaataaagcccttgtgaaagcatggtgctgtaacccgaaagtgccgcgcttgtcgcggcgctttt

SEQ ID NO: 11196 - RNA, 102 nt, synthetic construct
  misc_feature 1..102: note = Description of Artificial Sequence: Syntheticpolynucleotide
  source 1..102: mol_type = other RNA
ttataccataccaaggaaataaaggttccgatagtaaggcttcctgaataaggaatgccgcacgaagagtggcgtctctcaggaggcgtcactctttgtttt

SEQ ID NO: 11197 - RNA, 123 nt, synthetic construct
  misc_feature 1..123: note = Description of Artificial Sequence: Syntheticpolynucleotide
  source 1..123: mol_type = other RNA
tgtagccaatcggggtgagagccgttgctacaataaggccgtcattcatttgatgtgccgtggggtcactgtccggtcgcaagaccggacatcccctaaaccaccctcactccccatccattt

SEQ ID NO: 11198 - RNA, 121 nt, synthetic construct
  misc_feature 1..121: note = Description of Artificial Sequence: Syntheticpolynucleotide
  source 1..121: mol_type = other RNA
agtgtaactgactggcgcctgcgcagcttctcataacaaggagttccgcaaggaattccgcaggcaaccactgtccttcgggacgtggacccaccttggccgcccgcaagggcggcctttt

SEQ ID NO: 11199 - RNA, 84 nt, synthetic construct
  misc_feature 1..84: note = Description of Artificial Sequence: Syntheticoligonucleotide
  source 1..84: mol_type = other RNA
atagcaaataggaaaaggtggtctttccgttaacaagatgaaagattcacaaaattaaaaggcagagttccgtctctgcctttt

SEQ ID NO: 11200 - RNA, 112 nt, synthetic construct
  misc_feature 1..112: note = Description of Artificial Sequence: Syntheticpolynucleotide
  source 1..112: mol_type = other RNA
ttgagtaccatcagaagttacatcacgagttcaaaaaacatgatttattcaaatcgtcttcttcagaagaccccacagtgtgtggaactaaagcttgcttcggcaggctttt

SEQ ID NO: 11201 - RNA, 113 nt, synthetic construct
  misc_feature 1..113: note = Description of Artificial Sequence: Syntheticpolynucleotide
  source 1..113: mol_type = other RNA
ttgagtaccatcagaagttacatcacgagttcaaaaaacatgatttattcaaaccgtcttcttcggaaggccccacagtgtgtggacagtaaagcttgcttcggcaagctttt

SEQ ID NO: 11202 - RNA, 129 nt, synthetic construct
  misc_feature 1..129: note = Description of Artificial Sequence: Syntheticpolynucleotide
  source 1..129: mol_type = other RNA
gtttaccaccatatgagttcacactacaagttcaaatcaaaatttattctaatcgctctccggagcctccacaagagtggatttacaaatgtaattatgaaaagacttatttttccgataagtcttttt

SEQ ID NO: 11203 - RNA, 96 nt, synthetic construct
  misc_feature 1..96: note = Description of Artificial Sequence: Syntheticoligonucleotide
  source 1..96: mol_type = other RNA
aaatctatcagtaagtcactataataagtgaaatcgcaaggctctgttcttgaacatcctttattataaaactcctgccaatcggttgggagtttt

SEQ ID NO: 11204 - RNA, 104 nt, synthetic construct
  misc_feature 1..104: note = Description of Artificial Sequence: Syntheticpolynucleotide
  source 1..104: mol_type = other RNA
attatacaataaacctatcagtaagctactgtaataagtgcaatcgcaaggctctgttcttgaacatcctttatttataactccggccaagtgcccggagtttt

SEQ ID NO: 11205 - RNA, 100 nt, synthetic construct
  misc_feature 1..100: note = Description of Artificial Sequence: Syntheticpolynucleotide
  source 1..100: mol_type = other RNA
ttagcagagggcagttgggagcgcaaccacggtaatcttttctgtggaaaagagctcctgtatggggatggattttaagatctgtccccatacatctttt

SEQ ID NO: 11206 - RNA, 91 nt, synthetic construct
  misc_feature 1..91: note = Description of Artificial Sequence: Syntheticoligonucleotide
  source 1..91: mol_type = other RNA
ttgtatgacacacaagtttaataggggtattaaactaaggtcactttttagtggctgactttagagtatggctttggctatactccatttt

SEQ ID NO: 11207 - RNA, 91 nt, synthetic construct
  misc_feature 1..91: note = Description of Artificial Sequence: Syntheticoligonucleotide
  source 1..91: mol_type = other RNA
ttgtatgacatggttgtttaataggggtattaaactaagactacgattttcgtagttgactttaggtgatggtttcgaccgtcaccctttt

SEQ ID NO: 11208 - RNA, 82 nt, synthetic construct
  misc_feature 1..82: note = Description of Artificial Sequence: Syntheticoligonucleotide
  source 1..82: mol_type = other RNA
ttggacattgccaaaaattattagttttcttattataactctttaatgaggaaaccgggactacccaaaggtagtctctttt

SEQ ID NO: 11209 - RNA, 73 nt, synthetic construct
  misc_feature 1..73: note = Description of Artificial Sequence: Syntheticoligonucleotide
  source 1..73: mol_type = other RNA
catattcaaatttaacaaagattcctattattacacgaatgtggaatccaaaaagagggttaatccctctttt

SEQ ID NO: 11210 - RNA, 81 nt, synthetic construct
  misc_feature 1..81: note = Description of Artificial Sequence: Syntheticoligonucleotide
  source 1..81: mol_type = other RNA
gttgcatatttctcaaattatacagggtttcctattataactcattatgaggaacccaaaagataccttcgggtatctttt

SEQ ID NO: 11211 - RNA, 97 nt, synthetic construct
  misc_feature 1..97: note = Description of Artificial Sequence: Syntheticoligonucleotide
  source 1..97: mol_type = other RNA
atcaagttggaattagatgtctagtcgttaataagaacctcttgcaagagaggagatttcaccattaaaaacggacacttcggtgtccgtttatttt

SEQ ID NO: 11212 - RNA, 84 nt, synthetic construct
  misc_feature 1..84: note = Description of Artificial Sequence: Syntheticoligonucleotide
  source 1..84: mol_type = other RNA
gtagcatattggttttagatgtctagtcgctaataagaaatttatttcgatattaagcccgattacttaggtagtcgggctttt

SEQ ID NO: 11213 - RNA, 92 nt, synthetic construct
  misc_feature 1..92: note = Description of Artificial Sequence: Syntheticoligonucleotide
  source 1..92: mol_type = other RNA
tatcggatttaaatgtcaagtagtcaataagaacaattcataatgtaaaatggctgagttcgcctcagccattttttgttgaatatcacaaa

SEQ ID NO: 11214 - RNA, 87 nt, synthetic construct
  misc_feature 1..87: note = Description of Artificial Sequence: Syntheticoligonucleotide
  source 1..87: mol_type = other RNA
attgtgacactgtaagggatttcaacgttgttacaataaggttttcgaaagattaccgaacccgccctcacttaggtgagggctttt

SEQ ID NO: 11215 - RNA, 108 nt, synthetic construct
  misc_feature 1..108: note = Description of Artificial Sequence: Syntheticpolynucleotide
  source 1..108: mol_type = other RNA
attgtagcattgtaagggaattagacgttgttacaataaggttttcgaaagattaccgtacccgaccccacttaggtggggtctttcattatataagtaactactttt

SEQ ID NO: 11216 - RNA, 101 nt, synthetic construct
  misc_feature 1..101: note = Description of Artificial Sequence: Syntheticpolynucleotide
  source 1..101: mol_type = other RNA
attataacataccaagaataaaaaggttactatgacaaggctacgcagatgtgcgtacgccgcaagtatcccattcattcttcttgagtgagtgggatttt

SEQ ID NO: 11217 - RNA, 101 nt, synthetic construct
  misc_feature 1..101: note = Description of Artificial Sequence: Syntheticpolynucleotide
  source 1..101: mol_type = other RNA
attataacataccaagaataaaaaggttaatgtgacaaggctgcgcattcgtgcgtatgccgaacctatcccattcattcgttatgagtgaatgggatttt

SEQ ID NO: 11218 - RNA, 82 nt, synthetic construct
  misc_feature 1..82: note = Description of Artificial Sequence: Syntheticoligonucleotide
  source 1..82: mol_type = other RNA
tatagcatataggaaattctagtcagtcgttaataagaattttttcgtatttgtaggataagagttcgcctcttatcctttt

SEQ ID NO: 11219 - RNA, 89 nt, synthetic construct
  misc_feature 1..89: note = Description of Artificial Sequence: Syntheticoligonucleotide
  source 1..89: mol_type = other RNA
atagcatatagggaattctagttagtcgttaataagatttttttcgtacattaaaggaataaaagttcgccttttattccttatttttt

SEQ ID NO: 11220 - RNA, 81 nt, synthetic construct
  misc_feature 1..81: note = Description of Artificial Sequence: Syntheticoligonucleotide
  source 1..81: mol_type = other RNA
tccttatttgttagcttatcacaataaaagattattctgtaggtctttttagacctatgccccgcttattgcggggctttt

SEQ ID NO: 11221 - RNA, 107 nt, synthetic construct
  misc_feature 1..107: note = Description of Artificial Sequence: Syntheticpolynucleotide
  source 1..107: mol_type = other RNA
tataagttcatcaatattcatcagagttctaagataaggcaatatgccgtagggtagtggaaacccctttgcaccatatattaaagacaaccttagggttgtctttt

SEQ ID NO: 11222 - RNA, 107 nt, synthetic construct
  misc_feature 1..107: note = Description of Artificial Sequence: Syntheticpolynucleotide
  source 1..107: mol_type = other RNA
tataagtttatcaatattcatcagagttctaagataaggcaatatgccgtagggtagtggaaaccccttcgcaccatatattaaagacaaccttagggttgtctttt

SEQ ID NO: 11223 - RNA, 123 nt, synthetic construct
  misc_feature 1..123: note = Description of Artificial Sequence: Syntheticpolynucleotide
  source 1..123: mol_type = other RNA
gtataagtttatcaatattcatcagtaagttctaaaataaggcattatgccgtggggtatggtggtatcctcgttcaaatatccaccgtttctaaaaaaatcgcgcgccgccggcgtgctttt

SEQ ID NO: 11224 - RNA, 85 nt, synthetic construct
  misc_feature 1..85: note = Description of Artificial Sequence: Syntheticoligonucleotide
  source 1..85: mol_type = other RNA
ttctcttcgaatagcttgtcacaataaggccattaaggccgaaggttgtaaaacctatggctcgacttcggttgagccttctttt

SEQ ID NO: 11225 - RNA, 79 nt, synthetic construct
  misc_feature 1..79: note = Description of Artificial Sequence: Syntheticoligonucleotide
  source 1..79: mol_type = other RNA
ttctcttcttaagcttgtcacaataaggtcgtcatgaccgaaggcttaatgcctatagcccgacttcggttgggctttt

SEQ ID NO: 11226 - RNA, 93 nt, synthetic construct
  misc_feature 1..93: note = Description of Artificial Sequence: Syntheticoligonucleotide
  source 1..93: mol_type = other RNA
ttataccataccaagatacaaaaggttactgaaataagggatttttcccgtaaagctctgtccccgcggaaattttccacggggatatctttt

SEQ ID NO: 11227 - RNA, 87 nt, synthetic construct
  misc_feature 1..87: note = Description of Artificial Sequence: Syntheticoligonucleotide
  source 1..87: mol_type = other RNA
ccataccaaaaattaaaggtttctaaaacaagggttaattcccgaaaagctctatcccttgatgattttcatcaagggatatctttt

SEQ ID NO: 11228 - RNA, 86 nt, synthetic construct
  misc_feature 1..86: note = Description of Artificial Sequence: Syntheticoligonucleotide
  source 1..86: mol_type = other RNA
tagtgacttaggaaatgaggtttttcgccagtaataagctgaaaaactagcactaaatagggttcccgcaagggaaccctcgtttt

SEQ ID NO: 11229 - DNA, 22 bp, synthetic construct
  misc_feature 1..22: note = Description of Artificial Sequence: Syntheticoligonucleotide
  source 1..22: mol_type = other DNA
aatatgtagctgtttgggaggt

SEQ ID NO: 11230 - DNA, 22 bp, synthetic construct
  misc_feature 1..22: note = Description of Artificial Sequence: Syntheticoligonucleotide
  source 1..22: mol_type = other DNA
ctagggggcgctcggccaccac

SEQ ID NO: 11231 - DNA, 22 bp, synthetic construct
  misc_feature 1..22: note = Description of Artificial Sequence: Syntheticoligonucleotide
  source 1..22: mol_type = other DNA
tggctaaagagggaatgggctt

SEQ ID NO: 11232 - DNA, 22 bp, synthetic construct
  misc_feature 1..22: note = Description of Artificial Sequence: Syntheticoligonucleotide
  source 1..22: mol_type = other DNA
cacaccccggctctggctaaag

SEQ ID NO: 11233 - DNA, 22 bp, synthetic construct
  misc_feature 1..22: note = Description of Artificial Sequence: Syntheticoligonucleotide
  source 1..22: mol_type = other DNA
tcggaggagccgtggtccgcgc

SEQ ID NO: 11234 - DNA, 22 bp, synthetic construct
  misc_feature 1..22: note = Description of Artificial Sequence: Syntheticoligonucleotide
  source 1..22: mol_type = other DNA
gaagccgagccgagcggagccg

SEQ ID NO: 11235 - DNA, 22 bp, synthetic construct
  misc_feature 1..22: note = Description of Artificial Sequence: Syntheticoligonucleotide
  source 1..22: mol_type = other DNA
gcggaccacggctcctccgaag

SEQ ID NO: 11236 - DNA, 22 bp, synthetic construct
  misc_feature 1..22: note = Description of Artificial Sequence: Syntheticoligonucleotide
  source 1..22: mol_type = other DNA
gtacaaacggcagaagctggag

SEQ ID NO: 11237 - DNA, 23 bp, synthetic construct
  misc_feature 1..23: note = Description of Artificial Sequence: Syntheticoligonucleotide
  source 1..23: mol_type = other DNA
gaaggcaaacatcctgataatgg

SEQ ID NO: 11238 - DNA, 22 bp, synthetic construct
  misc_feature 1..22: note = Description of Artificial Sequence: Syntheticoligonucleotide
  source 1..22: mol_type = other DNA
tgtttgggaggtcagaaatagg

SEQ ID NO: 11239 - DNA, 22 bp, synthetic construct
  misc_feature 1..22: note = Description of Artificial Sequence: Syntheticoligonucleotide
  source 1..22: mol_type = other DNA
aaagcccattccctctttagcc

SEQ ID NO: 11240 - DNA, 22 bp, synthetic construct
  misc_feature 1..22: note = Description of Artificial Sequence: Syntheticoligonucleotide
  source 1..22: mol_type = other DNA
gacggcagtcactagggggcgc

SEQ ID NO: 11241 - DNA, 22 bp, synthetic construct
  misc_feature 1..22: note = Description of Artificial Sequence: Syntheticoligonucleotide
  source 1..22: mol_type = other DNA
tggaaagggggtggggggagtt

SEQ ID NO: 11242 - DNA, 22 bp, synthetic construct
  misc_feature 1..22: note = Description of Artificial Sequence: Syntheticoligonucleotide
  source 1..22: mol_type = other DNA
ggtggccgagcgccccctagtg

SEQ ID NO: 11243 - DNA, 22 bp, synthetic construct
  misc_feature 1..22: note = Description of Artificial Sequence: Syntheticoligonucleotide
  source 1..22: mol_type = other DNA
ccattcacccagcttccctgtg

SEQ ID NO: 11244 - DNA, 22 bp, synthetic construct
  misc_feature 1..22: note = Description of Artificial Sequence: Syntheticoligonucleotide
  source 1..22: mol_type = other DNA
gctgctcgctccattcacccag

SEQ ID NO: 11245 - DNA, 22 bp, synthetic construct
  misc_feature 1..22: note = Description of Artificial Sequence: Syntheticoligonucleotide
  source 1..22: mol_type = other DNA
tctgacacaactgtgttcacta

SEQ ID NO: 11246 - DNA, 22 bp, synthetic construct
  misc_feature 1..22: note = Description of Artificial Sequence: Syntheticoligonucleotide
  source 1..22: mol_type = other DNA
aaacagacaccatggtgcatct

SEQ ID NO: 11247 - DNA, 22 bp, synthetic construct
  misc_feature 1..22: note = Description of Artificial Sequence: Syntheticoligonucleotide
  source 1..22: mol_type = other DNA
gaacgtggatgaagttggtggt

SEQ ID NO: 11248 - DNA, 22 bp, synthetic construct
  misc_feature 1..22: note = Description of Artificial Sequence: Syntheticoligonucleotide
  source 1..22: mol_type = other DNA
tctttagccagagccggggtgt

SEQ ID NO: 11249 - DNA, 22 bp, synthetic construct
  misc_feature 1..22: note = Description of Artificial Sequence: Syntheticoligonucleotide
  source 1..22: mol_type = other DNA
tggaccccctatttctgacctc

SEQ ID NO: 11250 - DNA, 22 bp, synthetic construct
  misc_feature 1..22: note = Description of Artificial Sequence: Syntheticoligonucleotide
  source 1..22: mol_type = other DNA
atgggagcccttcttcttctgc

SEQ ID NO: 11251 - DNA, 22 bp, synthetic construct
  misc_feature 1..22: note = Description of Artificial Sequence: Syntheticoligonucleotide
  source 1..22: mol_type = other DNA
tgccacgaagcaggccaatggg

SEQ ID NO: 11252 - DNA, 22 bp, synthetic construct
  misc_feature 1..22: note = Description of Artificial Sequence: Syntheticoligonucleotide
  source 1..22: mol_type = other DNA
tggtgtctgtttgaggttgcta

SEQ ID NO: 11253 - DNA, 22 bp, synthetic construct
  misc_feature 1..22: note = Description of Artificial Sequence: Syntheticoligonucleotide
  source 1..22: mol_type = other DNA
gggcaggttggtatcaaggtta

SEQ ID NO: 11254 - DNA, 22 bp, synthetic construct
  misc_feature 1..22: note = Description of Artificial Sequence: Syntheticoligonucleotide
  source 1..22: mol_type = other DNA
aggtgctgacgtaggtagtgct

SEQ ID NO: 11255 - DNA, 22 bp, synthetic construct
  misc_feature 1..22: note = Description of Artificial Sequence: Syntheticoligonucleotide
  source 1..22: mol_type = other DNA
gccctacttccgctttcacctt

SEQ ID NO: 11256 - DNA, 22 bp, synthetic construct
  misc_feature 1..22: note = Description of Artificial Sequence: Syntheticoligonucleotide
  source 1..22: mol_type = other DNA
aatgtatgctggcttttaaggg

SEQ ID NO: 11257 - DNA, 22 bp, synthetic construct
  misc_feature 1..22: note = Description of Artificial Sequence: Syntheticoligonucleotide
  source 1..22: mol_type = other DNA
gctcctttggctagggaagtgt

SEQ ID NO: 11258 - DNA, 22 bp, synthetic construct
  misc_feature 1..22: note = Description of Artificial Sequence: Syntheticoligonucleotide
  source 1..22: mol_type = other DNA
atcaaactgtgagcatcttcag

SEQ ID NO: 11259 - DNA, 22 bp, synthetic construct
  misc_feature 1..22: note = Description of Artificial Sequence: Syntheticoligonucleotide
  source 1..22: mol_type = other DNA
cagcgaatctactcagccagag

SEQ ID NO: 11260 - DNA, 22 bp, synthetic construct
  misc_feature 1..22: note = Description of Artificial Sequence: Syntheticoligonucleotide
  source 1..22: mol_type = other DNA
ctttaacttgtgtgattctgga

SEQ ID NO: 11261 - DNA, 22 bp, synthetic construct
  misc_feature 1..22: note = Description of Artificial Sequence: Syntheticoligonucleotide
  source 1..22: mol_type = other DNA
agcttaattagctcctttggct

SEQ ID NO: 11262 - DNA, 22 bp, synthetic construct
  misc_feature 1..22: note = Description of Artificial Sequence: Syntheticoligonucleotide
  source 1..22: mol_type = other DNA
ccatggtgcatctgactcctga

SEQ ID NO: 11263 - DNA, 22 bp, synthetic construct
  misc_feature 1..22: note = Description of Artificial Sequence: Syntheticoligonucleotide
  source 1..22: mol_type = other DNA
tgcttgagaccgccagaagctc

SEQ ID NO: 11264 - DNA, 22 bp, synthetic construct
  misc_feature 1..22: note = Description of Artificial Sequence: Syntheticoligonucleotide
  source 1..22: mol_type = other DNA
cgagaacagcccagaagttgga

SEQ ID NO: 11265 - DNA, 22 bp, synthetic construct
  misc_feature 1..22: note = Description of Artificial Sequence: Syntheticoligonucleotide
  source 1..22: mol_type = other DNA
cggaggagccgtggtccgcgcg

SEQ ID NO: 11266 - DNA, 22 bp, synthetic construct
  misc_feature 1..22: note = Description of Artificial Sequence: Syntheticoligonucleotide
  source 1..22: mol_type = other DNA
atgtgtgagaaaaatttaatca

SEQ ID NO: 11267 - DNA, 22 bp, synthetic construct
  misc_feature 1..22: note = Description of Artificial Sequence: Syntheticoligonucleotide
  source 1..22: mol_type = other DNA
aggtccaagtaaaatttgtctt

SEQ ID NO: 11268 - DNA, 22 bp, synthetic construct
  misc_feature 1..22: note = Description of Artificial Sequence: Syntheticoligonucleotide
  source 1..22: mol_type = other DNA
aggaagggcctgagtccgagca

SEQ ID NO: 11269 - DNA, 22 bp, synthetic construct
  misc_feature 1..22: note = Description of Artificial Sequence: Syntheticoligonucleotide
  source 1..22: mol_type = other DNA
aagggcctgagtccgagcagaa

SEQ ID NO: 11270 - DNA, 22 bp, synthetic construct
  misc_feature 1..22: note = Description of Artificial Sequence: Syntheticoligonucleotide
  source 1..22: mol_type = other DNA
aaagacctatccattgcactat

SEQ ID NO: 11271 - DNA, 22 bp, synthetic construct
  misc_feature 1..22: note = Description of Artificial Sequence: Syntheticoligonucleotide
  source 1..22: mol_type = other DNA
gctgttgatctcataaatagaa

SEQ ID NO: 11272 - DNA, 22 bp, synthetic construct
  misc_feature 1..22: note = Description of Artificial Sequence: Syntheticoligonucleotide
  source 1..22: mol_type = other DNA
ggagcagattgtcatctccagc

SEQ ID NO: 11273 - DNA, 22 bp, synthetic construct
  misc_feature 1..22: note = Description of Artificial Sequence: Syntheticoligonucleotide
  source 1..22: mol_type = other DNA
ggtaattttccagcccgctggc

SEQ ID NO: 11274 - DNA, 22 bp, synthetic construct
  misc_feature 1..22: note = Description of Artificial Sequence: Syntheticoligonucleotide
  source 1..22: mol_type = other DNA
tgtaaaggaaactggaacacaa

SEQ ID NO: 11275 - DNA, 22 bp, synthetic construct
  misc_feature 1..22: note = Description of Artificial Sequence: Syntheticoligonucleotide
  source 1..22: mol_type = other DNA
caagtgcagaatatctgatgat

SEQ ID NO: 11276 - DNA, 22 bp, synthetic construct
  misc_feature 1..22: note = Description of Artificial Sequence: Syntheticoligonucleotide
  source 1..22: mol_type = other DNA
gagtgactgaaacttcacagaa

SEQ ID NO: 11277 - DNA, 22 bp, synthetic construct
  misc_feature 1..22: note = Description of Artificial Sequence: Syntheticoligonucleotide
  source 1..22: mol_type = other DNA
ttctatttatgagatcaacagc

SEQ ID NO: 11278 - DNA, 22 bp, synthetic construct
  misc_feature 1..22: note = Description of Artificial Sequence: Syntheticoligonucleotide
  source 1..22: mol_type = other DNA
cagatgcaccatggtgtctgtt

SEQ ID NO: 11279 - DNA, 22 bp, synthetic construct
  misc_feature 1..22: note = Description of Artificial Sequence: Syntheticoligonucleotide
  source 1..22: mol_type = other DNA
gaggccctgggcaggttggtat

SEQ ID NO: 11280 - DNA, 22 bp, synthetic construct
  misc_feature 1..22: note = Description of Artificial Sequence: Syntheticoligonucleotide
  source 1..22: mol_type = other DNA
aggttggtatcaaggttacaag

SEQ ID NO: 11281 - DNA, 22 bp, synthetic construct
  misc_feature 1..22: note = Description of Artificial Sequence: Syntheticoligonucleotide
  source 1..22: mol_type = other DNA
tcaactttcctggcaacttgcg

SEQ ID NO: 11282 - DNA, 22 bp, synthetic construct
  misc_feature 1..22: note = Description of Artificial Sequence: Syntheticoligonucleotide
  source 1..22: mol_type = other DNA
aggaacattcagttaagatagt

SEQ ID NO: 11283 - DNA, 22 bp, synthetic construct
  misc_feature 1..22: note = Description of Artificial Sequence: Syntheticoligonucleotide
  source 1..22: mol_type = other DNA
tttaaattatgaatccatctct

SEQ ID NO: 11284 - DNA, 22 bp, synthetic construct
  misc_feature 1..22: note = Description of Artificial Sequence: Syntheticoligonucleotide
  source 1..22: mol_type = other DNA
cccctatttctgacctcccaaa

SEQ ID NO: 11285 - DNA, 22 bp, synthetic construct
  misc_feature 1..22: note = Description of Artificial Sequence: Syntheticoligonucleotide
  source 1..22: mol_type = other DNA
tgtggttccagaaccggaggac

SEQ ID NO: 11286 - DNA, 22 bp, synthetic construct
  misc_feature 1..22: note = Description of Artificial Sequence: Syntheticoligonucleotide
  source 1..22: mol_type = other DNA
ggccctgggcaggttggtatca

SEQ ID NO: 11287 - DNA, 22 bp, synthetic construct
  misc_feature 1..22: note = Description of Artificial Sequence: Syntheticoligonucleotide
  source 1..22: mol_type = other DNA
tccttaaacctgtcttgtaacc

SEQ ID NO: 11288 - DNA, 22 bp, synthetic construct
  misc_feature 1..22: note = Description of Artificial Sequence: Syntheticoligonucleotide
  source 1..22: mol_type = other DNA
ctgactcctgaggagaagtctg

SEQ ID NO: 11289 - DNA, 22 bp, synthetic construct
  misc_feature 1..22: note = Description of Artificial Sequence: Syntheticoligonucleotide
  source 1..22: mol_type = other DNA
tccgagcttctggcggtctcaa

SEQ ID NO: 11290 - DNA, 22 bp, synthetic construct
  misc_feature 1..22: note = Description of Artificial Sequence: Syntheticoligonucleotide
  source 1..22: mol_type = other DNA
tatcatttcgcggatgttccaa

SEQ ID NO: 11291 - DNA, 22 bp, synthetic construct
  misc_feature 1..22: note = Description of Artificial Sequence: Syntheticoligonucleotide
  source 1..22: mol_type = other DNA
tcgggcagagggtgcatcacct

SEQ ID NO: 11292 - DNA, 22 bp, synthetic construct
  misc_feature 1..22: note = Description of Artificial Sequence: Syntheticoligonucleotide
  source 1..22: mol_type = other DNA
ataataagcagaacttttagtg

SEQ ID NO: 11293 - DNA, 22 bp, synthetic construct
  misc_feature 1..22: note = Description of Artificial Sequence: Syntheticoligonucleotide
  source 1..22: mol_type = other DNA
gttttctttagttattaatttc

SEQ ID NO: 11294 - DNA, 22 bp, synthetic construct
  misc_feature 1..22: note = Description of Artificial Sequence: Syntheticoligonucleotide
  source 1..22: mol_type = other DNA
gaagttggtggtgaggccctgg

SEQ ID NO: 11295 - DNA, 22 bp, synthetic construct
  misc_feature 1..22: note = Description of Artificial Sequence: Syntheticoligonucleotide
  source 1..22: mol_type = other DNA
agggggtccaggagcaaactcc

SEQ ID NO: 11296 - DNA, 22 bp, synthetic construct
  misc_feature 1..22: note = Description of Artificial Sequence: Syntheticoligonucleotide
  source 1..22: mol_type = other DNA
ttccaaagcccattccctcttt

SEQ ID NO: 11297 - DNA, 22 bp, synthetic construct
  misc_feature 1..22: note = Description of Artificial Sequence: Syntheticoligonucleotide
  source 1..22: mol_type = other DNA
gaatggagcgagcagcgtcttc

SEQ ID NO: 11298 - DNA, 22 bp, synthetic construct
  misc_feature 1..22: note = Description of Artificial Sequence: Syntheticoligonucleotide
  source 1..22: mol_type = other DNA
ttcactagcaacctcaaacaga

SEQ ID NO: 11299 - DNA, 22 bp, synthetic construct
  misc_feature 1..22: note = Description of Artificial Sequence: Syntheticoligonucleotide
  source 1..22: mol_type = other DNA
ggttacaagacaggtttaagga

SEQ ID NO: 11300 - DNA, 22 bp, synthetic construct
  misc_feature 1..22: note = Description of Artificial Sequence: Syntheticoligonucleotide
  source 1..22: mol_type = other DNA
tcaaggttacaagacaggttta

SEQ ID NO: 11301 - DNA, 22 bp, synthetic construct
  misc_feature 1..22: note = Description of Artificial Sequence: Syntheticoligonucleotide
  source 1..22: mol_type = other DNA
tacatagttgtgtgagggagca

SEQ ID NO: 11302 - DNA, 22 bp, synthetic construct
  misc_feature 1..22: note = Description of Artificial Sequence: Syntheticoligonucleotide
  source 1..22: mol_type = other DNA
atggtgaaaacctaccgcaagt

SEQ ID NO: 11303 - DNA, 22 bp, synthetic construct
  misc_feature 1..22: note = Description of Artificial Sequence: Syntheticoligonucleotide
  source 1..22: mol_type = other DNA
gtttctgactaccaagcatcgg

SEQ ID NO: 11304 - DNA, 22 bp, synthetic construct
  misc_feature 1..22: note = Description of Artificial Sequence: Syntheticoligonucleotide
  source 1..22: mol_type = other DNA
cttattaataaaattcaaacat

SEQ ID NO: 11305 - DNA, 22 bp, synthetic construct
  misc_feature 1..22: note = Description of Artificial Sequence: Syntheticoligonucleotide
  source 1..22: mol_type = other DNA
gttggtggtgaggccctgggca

SEQ ID NO: 11306 - DNA, 22 bp, synthetic construct
  misc_feature 1..22: note = Description of Artificial Sequence: Syntheticoligonucleotide
  source 1..22: mol_type = other DNA
ctagttaatggaataaaacatt

SEQ ID NO: 11307 - DNA, 22 bp, synthetic construct
  misc_feature 1..22: note = Description of Artificial Sequence: Syntheticoligonucleotide
  source 1..22: mol_type = other DNA
gcattataatgcaccaaggctt

SEQ ID NO: 11308 - DNA, 22 bp, synthetic construct
  misc_feature 1..22: note = Description of Artificial Sequence: Syntheticoligonucleotide
  source 1..22: mol_type = other DNA
gtggcggggtcccaggtgctga

SEQ ID NO: 11309 - DNA, 22 bp, synthetic construct
  misc_feature 1..22: note = Description of Artificial Sequence: Syntheticoligonucleotide
  source 1..22: mol_type = other DNA
tgtccgccgccggccggggagg

SEQ ID NO: 11310 - DNA, 22 bp, synthetic construct
  misc_feature 1..22: note = Description of Artificial Sequence: Syntheticoligonucleotide
  source 1..22: mol_type = other DNA
ggtgatgcaccctctgcccgat

SEQ ID NO: 11311 - DNA, 22 bp, synthetic construct
  misc_feature 1..22: note = Description of Artificial Sequence: Syntheticoligonucleotide
  source 1..22: mol_type = other DNA
ccacatcaactttcctggcaac

SEQ ID NO: 11312 - DNA, 23 bp, synthetic construct
  misc_feature 1..23: note = Description of Artificial Sequence: Syntheticoligonucleotide
  source 1..23: mol_type = other DNA
gctagttaatggaataaaacatt

SEQ ID NO: 11313 - DNA, 22 bp, synthetic construct
  misc_feature 1..22: note = Description of Artificial Sequence: Syntheticoligonucleotide
  source 1..22: mol_type = other DNA
cccccaccccctttccaaagcc

SEQ ID NO: 11314 - DNA, 22 bp, synthetic construct
  misc_feature 1..22: note = Description of Artificial Sequence: Syntheticoligonucleotide
  source 1..22: mol_type = other DNA
caaatcttaccataaaatgttt

SEQ ID NO: 11315 - DNA, 22 bp, synthetic construct
  misc_feature 1..22: note = Description of Artificial Sequence: Syntheticoligonucleotide
  source 1..22: mol_type = other DNA
tataatgcaccaaggctttata

SEQ ID NO: 11316 - DNA, 22 bp, synthetic construct
  misc_feature 1..22: note = Description of Artificial Sequence: Syntheticoligonucleotide
  source 1..22: mol_type = other DNA
aacctagactatcttaactgaa

SEQ ID NO: 11317 - DNA, 22 bp, synthetic construct
  misc_feature 1..22: note = Description of Artificial Sequence: Syntheticoligonucleotide
  source 1..22: mol_type = other DNA
agatggattcataatttaaaag

SEQ ID NO: 11318 - DNA, 22 bp, synthetic construct
  misc_feature 1..22: note = Description of Artificial Sequence: Syntheticoligonucleotide
  source 1..22: mol_type = other DNA
gccctgtgcatactgaggctta

SEQ ID NO: 11319 - DNA, 22 bp, synthetic construct
  misc_feature 1..22: note = Description of Artificial Sequence: Syntheticoligonucleotide
  source 1..22: mol_type = other DNA
tctccagctgggaggtgatggc

SEQ ID NO: 11320 - DNA, 22 bp, synthetic construct
  misc_feature 1..22: note = Description of Artificial Sequence: Syntheticoligonucleotide
  source 1..22: mol_type = other DNA
caaagcatagactgcggggcgg

SEQ ID NO: 11321 - DNA, 23 bp, synthetic construct
  misc_feature 1..23: note = Description of Artificial Sequence: Syntheticoligonucleotide
  source 1..23: mol_type = other DNA
gtgcttattatggacaagtagca

SEQ ID NO: 11322 - DNA, 23 bp, synthetic construct
  misc_feature 1..23: note = Description of Artificial Sequence: Syntheticoligonucleotide
  source 1..23: mol_type = other DNA
gtccctgaagatgctcacagttt

SEQ ID NO: 11323 - DNA, 23 bp, synthetic construct
  misc_feature 1..23: note = Description of Artificial Sequence: Syntheticoligonucleotide
  source 1..23: mol_type = other DNA
gttttatttctcctgcatatgat

SEQ ID NO: 11324 - DNA, 23 bp, synthetic construct
  misc_feature 1..23: note = Description of Artificial Sequence: Syntheticoligonucleotide
  source 1..23: mol_type = other DNA
gtgtggggcaaggtgaacgtgga

SEQ ID NO: 11325 - DNA, 23 bp, synthetic construct
  misc_feature 1..23: note = Description of Artificial Sequence: Syntheticoligonucleotide
  source 1..23: mol_type = other DNA
gatggtgcatctgactcctgagg

SEQ ID NO: 11326 - DNA, 23 bp, synthetic construct
  misc_feature 1..23: note = Description of Artificial Sequence: Syntheticoligonucleotide
  source 1..23: mol_type = other DNA
gagaacagcccagaagttggacg

SEQ ID NO: 11327 - DNA, 23 bp, synthetic construct
  misc_feature 1..23: note = Description of Artificial Sequence: Syntheticoligonucleotide
  source 1..23: mol_type = other DNA
gtcctccgaagcgagaacagccc

SEQ ID NO: 11328 - DNA, 22 bp, synthetic construct
  misc_feature 1..22: note = Description of Artificial Sequence: Syntheticoligonucleotide
  source 1..22: mol_type = other DNA
tccctctttagccagagccggg

SEQ ID NO: 11329 - DNA, 22 bp, synthetic construct
  misc_feature 1..22: note = Description of Artificial Sequence: Syntheticoligonucleotide
  source 1..22: mol_type = other DNA
ccaaagcccattccctctttag

SEQ ID NO: 11330 - DNA, 22 bp, synthetic construct
  misc_feature 1..22: note = Description of Artificial Sequence: Syntheticoligonucleotide
  source 1..22: mol_type = other DNA
gggggcgctcggccaccacagg

SEQ ID NO: 11331 - DNA, 22 bp, synthetic construct
  misc_feature 1..22: note = Description of Artificial Sequence: Syntheticoligonucleotide
  source 1..22: mol_type = other DNA
acaactgtgttcactagcaacc

SEQ ID NO: 11332 - DNA, 22 bp, synthetic construct
  misc_feature 1..22: note = Description of Artificial Sequence: Syntheticoligonucleotide
  source 1..22: mol_type = other DNA
gacaccatggtgcatctgactc

SEQ ID NO: 11333 - DNA, 22 bp, synthetic construct
  misc_feature 1..22: note = Description of Artificial Sequence: Syntheticoligonucleotide
  source 1..22: mol_type = other DNA
tcactagcaacctcaaacagac

SEQ ID NO: 11334 - DNA, 22 bp, synthetic construct
  misc_feature 1..22: note = Description of Artificial Sequence: Syntheticoligonucleotide
  source 1..22: mol_type = other DNA
gtatcaaggttacaagacaggt

SEQ ID NO: 11335 - DNA, 22 bp, synthetic construct
  misc_feature 1..22: note = Description of Artificial Sequence: Syntheticoligonucleotide
  source 1..22: mol_type = other DNA
gctggagcagtactctagtaac

SEQ ID NO: 11336 - DNA, 22 bp, synthetic construct
  misc_feature 1..22: note = Description of Artificial Sequence: Syntheticoligonucleotide
  source 1..22: mol_type = other DNA
aagcagaagacagaccggctgc

SEQ ID NO: 11337 - DNA, 22 bp, synthetic construct
  misc_feature 1..22: note = Description of Artificial Sequence: Syntheticoligonucleotide
  source 1..22: mol_type = other DNA
gaaatagggggtccaggagcaa

SEQ ID NO: 11338 - DNA, 22 bp, synthetic construct
  misc_feature 1..22: note = Description of Artificial Sequence: Syntheticoligonucleotide
  source 1..22: mol_type = other DNA
attccctctttagccagagccg

SEQ ID NO: 11339 - DNA, 22 bp, synthetic construct
  misc_feature 1..22: note = Description of Artificial Sequence: Syntheticoligonucleotide
  source 1..22: mol_type = other DNA
gaagctgggtgaatggagcgag

SEQ ID NO: 11340 - DNA, 22 bp, synthetic construct
  misc_feature 1..22: note = Description of Artificial Sequence: Syntheticoligonucleotide
  source 1..22: mol_type = other DNA
ctgacacaactgtgttcactag

SEQ ID NO: 11341 - DNA, 22 bp, synthetic construct
  misc_feature 1..22: note = Description of Artificial Sequence: Syntheticoligonucleotide
  source 1..22: mol_type = other DNA
gccgttactgccctgtggggca

SEQ ID NO: 11342 - DNA, 22 bp, synthetic construct
  misc_feature 1..22: note = Description of Artificial Sequence: Syntheticoligonucleotide
  source 1..22: mol_type = other DNA
ggcagagggtgcatcacctgga

SEQ ID NO: 11343 - DNA, 22 bp, synthetic construct
  misc_feature 1..22: note = Description of Artificial Sequence: Syntheticoligonucleotide
  source 1..22: mol_type = other DNA
gaatctgctatttgagcaaggc

SEQ ID NO: 11344 - DNA, 22 bp, synthetic construct
  misc_feature 1..22: note = Description of Artificial Sequence: Syntheticoligonucleotide
  source 1..22: mol_type = other DNA
actaccaagcatcgggcagagg

SEQ ID NO: 11345 - DNA, 22 bp, synthetic construct
  misc_feature 1..22: note = Description of Artificial Sequence: Syntheticoligonucleotide
  source 1..22: mol_type = other DNA
ggaggtcagaaatagggggtcc

SEQ ID NO: 11346 - DNA, 22 bp, synthetic construct
  misc_feature 1..22: note = Description of Artificial Sequence: Syntheticoligonucleotide
  source 1..22: mol_type = other DNA
caaagcccattccctctttagc

SEQ ID NO: 11347 - DNA, 22 bp, synthetic construct
  misc_feature 1..22: note = Description of Artificial Sequence: Syntheticoligonucleotide
  source 1..22: mol_type = other DNA
cggccaccacagggaagctggg

SEQ ID NO: 11348 - DNA, 22 bp, synthetic construct
  misc_feature 1..22: note = Description of Artificial Sequence: Syntheticoligonucleotide
  source 1..22: mol_type = other DNA
tgtgttcactagcaacctcaaa

SEQ ID NO: 11349 - DNA, 22 bp, synthetic construct
  misc_feature 1..22: note = Description of Artificial Sequence: Syntheticoligonucleotide
  source 1..22: mol_type = other DNA
ccgttactgccctgtggggcaa

SEQ ID NO: 11350 - DNA, 22 bp, synthetic construct
  misc_feature 1..22: note = Description of Artificial Sequence: Syntheticoligonucleotide
  source 1..22: mol_type = other DNA
aaggaaactggaacacaaagca

SEQ ID NO: 11351 - DNA, 22 bp, synthetic construct
  misc_feature 1..22: note = Description of Artificial Sequence: Syntheticoligonucleotide
  source 1..22: mol_type = other DNA
tccagcccgctggccctgtaaa

SEQ ID NO: 11352 - RNA, 110 nt, synthetic construct
  misc_feature 1..110: note = Description of Artificial Sequence: Syntheticpolynucleotide
  source 1..110: mol_type = other RNA
aattagccgggggagcattttcgttgagaatcgaaagattcttaataaggcatccttccgatgctgacttctcaccgtccgttttccaataggagcgggcggtatgtttt

SEQ ID NO: 11353 - RNA, 110 nt, synthetic construct
  misc_feature 1..110: note = Description of Artificial Sequence: Syntheticpolynucleotide
  source 1..110: mol_type = other RNA
cccagacctgtaatagtcatatgttgagaatcgaaagattcttaataaggcatccttccgatgctgacttctcaccgtccgttttccaataggagcgggcggtatgtttt

SEQ ID NO: 11354 - RNA, 110 nt, synthetic construct
  misc_feature 1..110: note = Description of Artificial Sequence: Syntheticpolynucleotide
  source 1..110: mol_type = other RNA
ccaaagtctatatatgactattgttgagaatcgaaagattcttaataaggcatccttccgatgctgacttctcaccgtccgttttccaataggagcgggcggtatgtttt

SEQ ID NO: 11355 - RNA, 110 nt, synthetic construct
  misc_feature 1..110: note = Description of Artificial Sequence: Syntheticpolynucleotide
  source 1..110: mol_type = other RNA
caaagtttcttcatcatttgccgttgagaatcgaaagattcttaataaggcatccttccgatgctgacttctcaccgtccgttttccaataggagcgggcggtatgtttt

SEQ ID NO: 11356 - RNA, 110 nt, synthetic construct
  misc_feature 1..110: note = Description of Artificial Sequence: Syntheticpolynucleotide
  source 1..110: mol_type = other RNA
gatgctccggaatgttgctgaagttgagaatcgaaagattcttaataaggcatccttccgatgctgacttctcaccgtccgttttccaataggagcgggcggtatgtttt

SEQ ID NO: 11357 - RNA, 110 nt, synthetic construct
  misc_feature 1..110: note = Description of Artificial Sequence: Syntheticpolynucleotide
  source 1..110: mol_type = other RNA
ctctgtcctaaaacagaagtcggttgagaatcgaaagattcttaataaggcatccttccgatgctgacttctcaccgtccgttttccaataggagcgggcggtatgtttt

SEQ ID NO: 11358 - RNA, 110 nt, synthetic construct
  misc_feature 1..110: note = Description of Artificial Sequence: Syntheticpolynucleotide
  source 1..110: mol_type = other RNA
tgtcgacttctgttttaggacagttgagaatcgaaagattcttaataaggcatccttccgatgctgacttctcaccgtccgttttccaataggagcgggcggtatgtttt

SEQ ID NO: 11359 - RNA, 110 nt, synthetic construct
  misc_feature 1..110: note = Description of Artificial Sequence: Syntheticpolynucleotide
  source 1..110: mol_type = other RNA
gggtcagcatgccaatatgtgtgttgagaatcgaaagattcttaataaggcatccttccgatgctgacttctcaccgtccgttttccaataggagcgggcggtatgtttt

SEQ ID NO: 11360 - RNA, 110 nt, synthetic construct
  misc_feature 1..110: note = Description of Artificial Sequence: Syntheticpolynucleotide
  source 1..110: mol_type = other RNA
tcatgcccgttcccagggactggttgagaatcgaaagattcttaataaggcatccttccgatgctgacttctcaccgtccgttttccaataggagcgggcggtatgtttt

SEQ ID NO: 11361 - RNA, 110 nt, synthetic construct
  misc_feature 1..110: note = Description of Artificial Sequence: Syntheticpolynucleotide
  source 1..110: mol_type = other RNA
actcaacatcatgcccgttcccgttgagaatcgaaagattcttaataaggcatccttccgatgctgacttctcaccgtccgttttccaataggagcgggcggtatgtttt

SEQ ID NO: 11362 - RNA, 110 nt, synthetic construct
  misc_feature 1..110: note = Description of Artificial Sequence: Syntheticpolynucleotide
  source 1..110: mol_type = other RNA
gaacgggcatgatgttgagttcgttgagaatcgaaagattcttaataaggcatccttccgatgctgacttctcaccgtccgttttccaataggagcgggcggtatgtttt

SEQ ID NO: 11363 - RNA, 110 nt, synthetic construct
  misc_feature 1..110: note = Description of Artificial Sequence: Syntheticpolynucleotide
  source 1..110: mol_type = other RNA
agttgcagccaacgaagtgcctgttgagaatcgaaagattcttaataaggcatccttccgatgctgacttctcaccgtccgttttccaataggagcgggcggtatgtttt

SEQ ID NO: 11364 - RNA, 110 nt, synthetic construct
  misc_feature 1..110: note = Description of Artificial Sequence: Syntheticpolynucleotide
  source 1..110: mol_type = other RNA
ttggctgcaactgtatatctacgttgagaatcgaaagattcttaataaggcatccttccgatgctgacttctcaccgtccgttttccaataggagcgggcggtatgtttt

SEQ ID NO: 11365 - RNA, 110 nt, synthetic construct
  misc_feature 1..110: note = Description of Artificial Sequence: Syntheticpolynucleotide
  source 1..110: mol_type = other RNA
gctagtgcggcaggcagagaaggttgagaatcgaaagattcttaataaggcatccttccgatgctgacttctcaccgtccgttttccaataggagcgggcggtatgtttt

SEQ ID NO: 11366 - RNA, 110 nt, synthetic construct
  misc_feature 1..110: note = Description of Artificial Sequence: Syntheticpolynucleotide
  source 1..110: mol_type = other RNA
ggcaggcagagaagatgggctagttgagaatcgaaagattcttaataaggcatccttccgatgctgacttctcaccgtccgttttccaataggagcgggcggtatgtttt

SEQ ID NO: 11367 - RNA, 110 nt, synthetic construct
  misc_feature 1..110: note = Description of Artificial Sequence: Syntheticpolynucleotide
  source 1..110: mol_type = other RNA
aaccgtctggatgatgtgcgtagttgagaatcgaaagattcttaataaggcatccttccgatgctgacttctcaccgtccgttttccaataggagcgggcggtatgtttt

SEQ ID NO: 11368 - RNA, 110 nt, synthetic construct
  misc_feature 1..110: note = Description of Artificial Sequence: Syntheticpolynucleotide
  source 1..110: mol_type = other RNA
gaggaaaattttggagacgacagttgagaatcgaaagattcttaataaggcatccttccgatgctgacttctcaccgtccgttttccaataggagcgggcggtatgtttt

SEQ ID NO: 11369 - RNA, 110 nt, synthetic construct
  misc_feature 1..110: note = Description of Artificial Sequence: Syntheticpolynucleotide
  source 1..110: mol_type = other RNA
tgctgcatatgtggctaaagcagttgagaatcgaaagattcttaataaggcatccttccgatgctgacttctcaccgtccgttttccaataggagcgggcggtatgtttt

SEQ ID NO: 11370 - RNA, 110 nt, synthetic construct
  misc_feature 1..110: note = Description of Artificial Sequence: Syntheticpolynucleotide
  source 1..110: mol_type = other RNA
ttgatatcttcccagctgataggttgagaatcgaaagattcttaataaggcatccttccgatgctgacttctcaccgtccgttttccaataggagcgggcggtatgtttt

SEQ ID NO: 11371 - RNA, 110 nt, synthetic construct
  misc_feature 1..110: note = Description of Artificial Sequence: Syntheticpolynucleotide
  source 1..110: mol_type = other RNA
tgggaagatatcaaatggctgagttgagaatcgaaagattcttaataaggcatccttccgatgctgacttctcaccgtccgttttccaataggagcgggcggtatgtttt

SEQ ID NO: 11372 - RNA, 110 nt, synthetic construct
  misc_feature 1..110: note = Description of Artificial Sequence: Syntheticpolynucleotide
  source 1..110: mol_type = other RNA
aattgttgcaaagggcattttggttgagaatcgaaagattcttaataaggcatccttccgatgctgacttctcaccgtccgttttccaataggagcgggcggtatgtttt

SEQ ID NO: 11373 - DNA, 3649 bp, synthetic construct
  misc_feature 1..3649: note = Description of Artificial Sequence: Syntheticpolynucleotide
  source 1..3649: mol_type = other DNA
aaaagccagctccagcaggcgctgctcactcctccccatcctctccctctgtccctctgtccctctgaccctgcactgtcccagcaccatggcccccaagaagaagcggaaagttggcggcggaggcagcagcaccgacatgaagaactaccggatcggcgtggacgtgggcgatagatctgttggactggccgccatcgagttcgacgatgatggactgcccatccagaagctggccctggtcacctttagacacgatggcggactggaccccaccaagaacaagacccctatgagccggaaagagacacggggaatcgccagacggaccatgcggatgaacagagagcggaagcggcggctgagaaacctggacaacgtgctggaaaacctgggctactctgtgcctgagggccctgagcctgagacatatgaggcctggacaagcagagccctgctggcctctatcaaactggcctctgccgacgagctgaacgaacaccttgtcagagccgtgcggcacatggccagacatagaggatgggccaatccttggtggtccctggaccagctggaaaaggccagccaagagcctagcgagacattcgagatcatcctggccagagccagagagctgttcggcgagaaggtgcccgctaatcctacactgggaatgctgggagccctggccgctaacaatgaggtgctgctgaggcccagggacgagaagaagagaaagaccggatacgtgcggggcacccctctgatgtttgctcaagttcgacagggcgatcagctggccgagctgcggagaatttgtgaagtgcagggcatcgaggaccagtacgaggctctgagactgggcgtgttcgaccacaagcacccctacgtgcccaaagaaagagtgggcaaagaccctctgaaccccagcaccaacagaaccatcagagccagcctggaatttcaagagttccgcatcctggacagcgtggccaatctgagagtgcggatcggcagcagagccaagagggaactgacagaggccgagtatgatgccgccgtggaattcctgatggactacgccgacaaagagcagcctagctgggccgatgtggccgagaaaattggcgtgcccggcaacagactggtggcccctgttctggaagatgtgcagcagaaaacagccccttacgacagaagcagcgccgcctttgagaaggccatgggcaagaaaaccgaggccagacagtggtgggagtccaccgatgatgaccagctgagaagcctgctgattgccttcctggtggacgccaccaacgacacagaagaagccgctgctgaagccggcctgagcgagctgtataagtcttggcctgccgaggaaagagaggccctgtccaacatcgacttcgagaagggcagagtggcctacagccaagaaaccctgagcaagctgagcgagtacatgcacgagtacagagtgggactgcacgaggctagaaaggccgtgttcggagtggatgatacctggcggcctcctctggataagctggaagaacctacaggacagcctgccgtggacagagtgctgaccatcctgagaagattcgtgctggactgcgagcggcaatggggcagacctagagccatcaccgtggaacacacacggacaggcctgatgggcccaacacagagacagaagatcctgaacgagcagaagaagaaccgggccgacaacgagagaatccgggatgagctgagagaatctggcgtggacaacccctccagagccgaagttcggagacacctgatcgtgcaagagcaagagtgccagtgcctgtactgcggcaccatgatcaccaccaccacaagcgagctggaccacatcgttcctagagccggtggcggcagcagcagaagggaaaatctggccgctgtgtgcagagcctgcaacgccaagaagaaacgcgagctgttctacgcctgggctggcccagtgaagtcccaagagacaatcgagagagtcagacagctgaaggcctttaaggacagcaagaaagccaagatgttcaagaaccagatccgccggctgaaccagaccgaggccgatgagcctatcgacgaaagaagcctggccagcacatcttacgccgctgtggccgttagagagcggctggaacagcacttcaacgaaggcctggcactggacgacaagtccagagtggtgctggatgtgtatgccggcgctgtgaccagagagtctcgtagagctggcggcatcgacgagcggattctgctgagaggcgagcgggacaagaacagattcgatgtgcggcatcacgccgtggacgctgctgttatgaccctgctgaacagatccgtggctctgaccctggaacagagatcacagctgcggcggaccttctacgagcaaggactggacaaactggaccggaaccagctgaagcccgaggaagattggagagacttcaccggactggcccctgcctctcaagagaagtttctggaatggcggaaggccgccaccatcctgggagatttgctggccgaagccatcgaggatgactctatcgccgtggtgtccccactgagactgaggccacagaatggcagcgtgcacctggaaacaatcagcgccgtgaagaagcagaccctgggctctgattggccagccgacgccgtgaaaagaatcgtggaccccgagatctacctggctatgaaggatgccctgggaaagctgaaagagctgcccgaggatagcgccagatctctggaactgcccgacggcagattcgtggaagccgatgacgaggtgctgttcttcccagagaacgccgccagcattctgacccctagaggcgtggcagagatcggcggctctattcaccatgccagactgtacggctggctgaccaaaaagggcgagctgaaagtgggcatgctgagagtgtacggcgccgagtttccctggctgatgagagagtccggctccagaaacgtgctgagcatgcctatccacagaggcagccagagcttccgggacatgcaggacacaacccggaaagccgtggaaagcggagaggctgtggaattcgcctggatcacccagaacgatgagctggaattcgaccccgacgactacattgcccacggcggaaaggacgaactgagacagttcctgggctttatgcccgagtgccgttggagagtggacggcttcaagaagaattaccagatcagaatcaggcccgccatgctgagcagagagcagctgcctagcgacatccagcggagactggaaagcaagaccctgaccaagaacgagtccctgctgctgaaagccctggatacaggactggtggtggccatcggaggactgctgcctctcgagacactgaaagtgatccggcgcaacaatctgggcttccccaggtggcgcggaaacggaaatctgcccaccagctttgaagtgcggagcagcgctctgagagccctgggagttgaaggatctggcggaaaaagacctgccgccacaaagaaagccggacaggccaagaaaaagaagtgaccacacccccattcccccactccagatagaacttcagttatatctcacgtgtctggagtt

SEQ ID NO: 11374 - RNA, 214 nt, synthetic construct
  source 1..214: mol_type = other RNA
  modified_base 1: mod_base = OTHER; note = 2'-O-Methyladenosine
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = phosphorothioate bond
  modified_base 211^212: mod_base = OTHER; note = Phosphorothioate bond
  modified_base 212^213: mod_base = OTHER; note = phosphorothioate bond
  modified_base 213^214: mod_base = OTHER; note = Phosphorothioate bond
  modified_base 2: mod_base = gm
agcntngncnangncntngngntntncnanancngngncnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11375 - RNA, 214 nt, synthetic construct
  source 1..214: mol_type = other RNA
  modified_base 1: mod_base = gm
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphonothioate bond
  modified_base 213^214: mod_base = OTHER; note = Phosphorothioate bond
ggtngngnangngnangncntngncncntngncncntngncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11376 - RNA, 214 nt, synthetic construct
  source 1..214: mol_type = other RNA
  modified_base 1: mod_base = cm
  modified_base 2: mod_base = cm
  modified_base 3: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 212: mod_base = um
  modified_base 213: mod_base = um
  modified_base 214: mod_base = um
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
cctngncncntngncncnangngnancncntngncnangncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11377 - RNA, 214 nt, synthetic construct
  source 1..214: mol_type = other RNA
  modified_base 1: mod_base = gm
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = phosphorothioate bond
  modified_base 2^3: mod_base = OTHER; note = phosphorothioate bond
  modified_base 3^4: mod_base = OTHER; note = phosphorothioate bond
  modified_base 211^212: mod_base = OTHER; note = phosphorothioate bond
  modified_base 212^213: mod_base = OTHER; note = phosphorothioate bond
  modified_base 213^214: mod_base = OTHER; note = phosphorothioate bond
gggngncntngntncnancntngntntngntncngncntngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11378 - RNA, 214 nt, synthetic construct
  source 1..214: mol_type = other RNA
  modified_base 1: mod_base = gm
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 213^214: mod_base = OTHER; note = Phosphorothioate bond
  modified_base 213^214: mod_base = OTHER; note = Phosphorothioate bond
gggncncntngngntngngntngngngncngntngncncnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11379 - RNA, 214 nt, synthetic construct
  source 1..214: mol_type = other RNA
  modified_base 1: mod_base = um
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tggntngncntngngncncnanancncntnancnancnangngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11380 - RNA, 214 nt, synthetic construct
  source 1..214: mol_type = other RNA
  modified_base 1: mod_base = gm
  modified_base 2: mod_base = um
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gtancntntntngntncnanancnantngngncnangntngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11381 - RNA, 214 nt, synthetic construct
  source 1..214: mol_type = other RNA
  modified_base 1: mod_base = gm
  modified_base 2: mod_base = cm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gcgngncngnanangntncncnancngntngngncnancntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11382 - RNA, 214 nt, synthetic construct
  source 1..214: mol_type = other RNA
  modified_base 1: mod_base = OTHER; note = 2'-O-Methyladenosine
  modified_base 2: mod_base = cm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
actnancnantncngnangncngntngncnancntngncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11383 - RNA, 214 nt, synthetic construct
  source 1..214: mol_type = other RNA
  modified_base 1: mod_base = cm
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 213^214: mod_base = OTHER; note = Phosphorothioate bond
  modified_base 212^213: mod_base = OTHER; note = Phosphorothioate bond
cgtncncngncnangngngnangngnancnancngncncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11384 - RNA, 214 nt, synthetic construct
  source 1..214: mol_type = other RNA
  modified_base 1: mod_base = gm
  modified_base 2: mod_base = gm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
ggancnancngncncncncntngngnancncngngngnancngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11385 - RNA, 214 nt, synthetic construct
  source 1..214: mol_type = other RNA
  modified_base 1: mod_base = gm
  modified_base 2: mod_base = gm
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
ggcncngngncntngngnangncncncntncngngncnancngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11386 - RNA, 214 nt, synthetic construct
  source 1..214: mol_type = other RNA
  modified_base 1: mod_base = gm
  modified_base 2: mod_base = um
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gtgngncncnancncngntngntngncnancngncnangntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11387 - RNA, 214 nt, synthetic construct
  source 1..214: mol_type = other RNA
  modified_base 1: mod_base = OTHER; note = 2'-O-Methyladenosine
  modified_base 2: mod_base = OTHER; note = 2'-O-Methyladenosine
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
aagncncncngntngngnancngncnancnancntnancncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11388 - RNA, 214 nt, synthetic construct
  source 1..214: mol_type = other RNA
  modified_base 1: mod_base = cm
  modified_base 2: mod_base = cm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
cctngngngngncntnancntngncnancntntntngntngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11389 - RNA, 214 nt, synthetic construct
  source 1..214: mol_type = other RNA
  modified_base 1: mod_base = gm
  modified_base 2: mod_base = cm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gctngnantngnananananangncntngncncncntngncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11390 - RNA, 214 nt, synthetic construct
  source 1..214: mol_type = other RNA
  modified_base 1: mod_base = cm
  modified_base 2: mod_base = um
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
ctgncngngngngnancncngngncnancntngncntncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11391 - RNA, 214 nt, synthetic construct
  source 1..214: mol_type = other RNA
  modified_base 1: mod_base = gm
  modified_base 2: mod_base = um
  modified_base 3: mod_base = gm
  modified_base 212: mod_base = um
  modified_base 212: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gtgngntngntncnancnananangncntngncntngngnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11392 - RNA, 214 nt, synthetic construct
  source 1..214: mol_type = other RNA
  modified_base 1: mod_base = um
  modified_base 2: mod_base = OTHER; note = 2'-O-Methyladenosine
  modified_base 3: mod_base = gm
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 212: mod_base = um
  modified_base 213: mod_base = um
  modified_base 214: mod_base = um
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tagncncncncnangngntnangntngntngncngntncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11393 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
agantngnantngnancncngntngntngncncncncnangngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11394 - RNA, 214 nt, synthetic construct
  source 1..214: mol_type = other RNA
  modified_base 1: mod_base = gm
  modified_base 2: mod_base = gm
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
ggcncnancncnangncnangncncntngntngntngncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11395 - RNA, 214 nt, synthetic construct
  source 1..214: mol_type = other RNA
  modified_base 1: mod_base = gm
  modified_base 2: mod_base = cm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gcgntngntntngntnancnancngncntngngncncnantngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11396 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
agtngncnancngncntncngnantngntnangntngngntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11397 - RNA, 214 nt, synthetic construct
  source 1..214: mol_type = other RNA
  modified_base 1: mod_base = cm
  modified_base 2: mod_base = cm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 212^213: mod_base = OTHER; note = Phosphorothioate bond
  modified_base 211^212: mod_base = OTHER; note = Phosphorothioate bond
  modified_base 213^214: mod_base = OTHER; note = Phosphorothioate bond
ccancncnangntngnangngnancnancnantntngnanangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11398 - RNA, 214 nt, synthetic construct
  source 1..214: mol_type = other RNA
  modified_base 1: mod_base = gm
  modified_base 2: mod_base = um
  modified_base 3: mod_base = OTHER; note = Phosphorothioate bond
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tganangngngngnantncntngncnangntngncncnancngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11399 - RNA, 214 nt, synthetic construct
  source 1..214: mol_type = other RNA
  modified_base 1: mod_base = cm
  modified_base 2: mod_base = OTHER; note = 2'-O-Methyladenosine
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
cacnangncngncncncnancncngngngnangncntncngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11400 - RNA, 214 nt, synthetic construct
  source 1..214: mol_type = other RNA
  modified_base 1: mod_base = um
  modified_base 2: mod_base = cm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 213^214: mod_base = OTHER; note = Phosphorothioate bond
  modified_base 212^213: mod_base = OTHER; note = Phosphorothioate bond
tcgngngngngngncncngnangncnangngntngncnancngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11401 - RNA, 214 nt, synthetic construct
  source 1..214: mol_type = other RNA
  modified_base 1: mod_base = OTHER; note = 2'-O-Methyladenosine
  modified_base 2: mod_base = cm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
acangngngngncncnangngngncngncntngnangncnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11402 - RNA, 214 nt, synthetic construct
  source 1..214: mol_type = other RNA
  modified_base 1: mod_base = OTHER; note = 2'-O-Methyladenosine
  modified_base 2: mod_base = um
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
atgngntncnantngncntngngncncntntngncntngntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11403 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = cm
  modified_base 213: mod_base = um
  modified_base 212: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
agcnancncnangncnangngngncngntntngntnangncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11404 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = gm
  modified_base 212: mod_base = um
  modified_base 212: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
aggncncncnancntngngncnancngncncncnancncnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11405 - RNA, 214 nt, synthetic construct
  source 1..214: mol_type = other RNA
  modified_base 1: mod_base = gm
  modified_base 2: mod_base = OTHER; note = 2'-O-Methyladenosine
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gacnanancnangntngnancnangncncncncnangncntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11406 - DNA, 22 bp, synthetic construct
  source 1..22: mol_type = other DNA
agctgcagctggttcaacggca

SEQ ID NO: 11407 - DNA, 22 bp, synthetic construct
  source 1..22: mol_type = other DNA
ggtggaggagctgcctgcctgc

SEQ ID NO: 11408 - DNA, 22 bp, synthetic construct
  source 1..22: mol_type = other DNA
cctgcctgccaggacctgcagc

SEQ ID NO: 11409 - DNA, 22 bp, synthetic construct
  source 1..22: mol_type = other DNA
ggggctgtcactgttgtcgctg

SEQ ID NO: 11410 - DNA, 22 bp, synthetic construct
  source 1..22: mol_type = other DNA
gggcctggtggtgggcgtgcca

SEQ ID NO: 11411 - DNA, 22 bp, synthetic construct
  source 1..22: mol_type = other DNA
tggtgctggccaacctacacag

SEQ ID NO: 11412 - DNA, 22 bp, synthetic construct
  source 1..22: mol_type = other DNA
gtactttgtcaacatggcagtg

SEQ ID NO: 11413 - DNA, 22 bp, synthetic construct
  source 1..22: mol_type = other DNA
gcggcgaagtccacgtggcact

SEQ ID NO: 11414 - DNA, 22 bp, synthetic construct
  source 1..22: mol_type = other DNA
actacatcgagcgtgcactgcc

SEQ ID NO: 11415 - DNA, 22 bp, synthetic construct
  source 1..22: mol_type = other DNA
cgtccgcagggaggacacgccc

SEQ ID NO: 11416 - DNA, 22 bp, synthetic construct
  source 1..22: mol_type = other DNA
ggacacgcccctggaccgggac

SEQ ID NO: 11417 - DNA, 22 bp, synthetic construct
  source 1..22: mol_type = other DNA
ggccggctggagccctcggcac

SEQ ID NO: 11418 - skipped

SEQ ID NO: 11419 - DNA, 22 bp, synthetic construct
  source 1..22: mol_type = other DNA
aagcccgtggacgcacactacc

SEQ ID NO: 11420 - DNA, 22 bp, synthetic construct
  source 1..22: mol_type = other DNA
cctggggctactgcactttgtg

SEQ ID NO: 11421 - DNA, 22 bp, synthetic construct
  source 1..22: mol_type = other DNA
gctgatgaaaaagctgccctgc

SEQ ID NO: 11422 - DNA, 22 bp, synthetic construct
  source 1..22: mol_type = other DNA
ctgcggggaccggcactgctcc

SEQ ID NO: 11423 - DNA, 22 bp, synthetic construct
  source 1..22: mol_type = other DNA
gtggtgtcacaaagctgctgga

SEQ ID NO: 11424 - DNA, 22 bp, synthetic construct
  source 1..22: mol_type = other DNA
tagccccaggtagtgtgcgtcc

SEQ ID NO: 11425 - DNA, 22 bp, synthetic construct
  source 1..22: mol_type = other DNA
agatgatgaccgtgtgccccag

SEQ ID NO: 11426 - DNA, 22 bp, synthetic construct
  source 1..22: mol_type = other DNA
ggccaccagcagcctgtgtgcc

SEQ ID NO: 11427 - DNA, 22 bp, synthetic construct
  source 1..22: mol_type = other DNA
gcgtgttgtacacgctggccat

SEQ ID NO: 11428 - DNA, 22 bp, synthetic construct
  source 1..22: mol_type = other DNA
agtgcacgctcgatgtagtggt

SEQ ID NO: 11429 - DNA, 22 bp, synthetic construct
  source 1..22: mol_type = other DNA
ccaccagtgaggacacattgaa

SEQ ID NO: 11430 - DNA, 22 bp, synthetic construct
  source 1..22: mol_type = other DNA
tgaaggggatctgcagtgccac

SEQ ID NO: 11431 - DNA, 22 bp, synthetic construct
  source 1..22: mol_type = other DNA
cacagcgcccaccgggagctcg

SEQ ID NO: 11432 - DNA, 22 bp, synthetic construct
  source 1..22: mol_type = other DNA
tcggggggccgagcaggtgcac

SEQ ID NO: 11433 - DNA, 22 bp, synthetic construct
  source 1..22: mol_type = other DNA
acaggggccagggcgctgagca

SEQ ID NO: 11434 - DNA, 22 bp, synthetic construct
  source 1..22: mol_type = other DNA
atggtcatgctggccttgctgt

SEQ ID NO: 11435 - DNA, 22 bp, synthetic construct
  source 1..22: mol_type = other DNA
agcaccagcagggcgttgtagc

SEQ ID NO: 11436 - DNA, 22 bp, synthetic construct
  source 1..22: mol_type = other DNA
aggcccactggcacgcccacca

SEQ ID NO: 11437 - DNA, 22 bp, synthetic construct
  source 1..22: mol_type = other DNA
gacaacagtgacagccccagct

SEQ ID NO: 11438 - RNA, 214 nt, synthetic construct
  source 1..214: mol_type = other RNA
  modified_base 1: mod_base = gm
  modified_base 2: mod_base = um
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gtgngncncncnancntncnanancnangncnancnangncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11439 - RNA, 214 nt, synthetic construct
  source 1..214: mol_type = other RNA
  modified_base 1: mod_base = cm
  modified_base 2: mod_base = cm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
ccgncntngntngncncngngnanancncntngncngncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11440 - RNA, 214 nt, synthetic construct
  source 1..214: mol_type = other RNA
  modified_base 1: mod_base = gm
  modified_base 2: mod_base = cm
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gccngngnanancncntngncngncncntngngngngncntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11441 - RNA, 214 nt, synthetic construct
  source 1..214: mol_type = other RNA
  modified_base 1: mod_base = um
  modified_base 2: mod_base = cm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tctncngncntngncntncntnancncntngngngngngncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11442 - RNA, 214 nt, synthetic construct
  source 1..214: mol_type = other RNA
  modified_base 1: mod_base = gm
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 211^212: mod_base = OTHER; note = Phosphorothioate bond
  modified_base 3^4: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gggngngncnangngngngntncncncntngntngnangncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11443 - RNA, 214 nt, synthetic construct
  source 1..214: mol_type = other RNA
  modified_base 1: mod_base = um
  modified_base 2: mod_base = OTHER; note = 2'-O-Methyladenosine
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tacntntncngntngnanancnantngngncncngntngngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11444 - RNA, 214 nt, synthetic construct
  source 1..214: mol_type = other RNA
  modified_base 1: mod_base = gm
  modified_base 2: mod_base = gm
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
ggcnancntngngncnancncntngncngntnancncntngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11445 - RNA, 214 nt, synthetic construct
  source 1..214: mol_type = other RNA
  modified_base 1: mod_base = um
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 213^214: mod_base = OTHER; note = Phosphorothioate bond
  modified_base 212^213: mod_base = OTHER; note = Phosphorothioate bond
tgtntngngngncncncntngncncncnancntncncnangngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11446 - RNA, 214 nt, synthetic construct
  source 1..214: mol_type = other RNA
  modified_base 1: mod_base = gm
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gggncncncntngntngngnangncncntncnangncnangngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11447 - RNA, 214 nt, synthetic construct
  source 1..214: mol_type = other RNA
  modified_base 1: mod_base = um
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tgtngncntncnantncngngncntnancngntngngntngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11448 - RNA, 214 nt, synthetic construct
  source 1..214: mol_type = other RNA
  modified_base 1: mod_base = OTHER; note = 2'-O-Methyladenosine
  modified_base 2: mod_base = OTHER; note = 2'-O-Methyladenosine
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
aatncngngngnanangngnanangnancnancnancncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11449 - RNA, 214 nt, synthetic construct
  source 1..214: mol_type = other RNA
  modified_base 1: mod_base = OTHER; note = 2'-O-Methyladenosine
  modified_base 2: mod_base = cm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
acancncncncntngngnancncnangngnancnancncnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11450 - RNA, 214 nt, synthetic construct
  source 1..214: mol_type = other RNA
  modified_base 1: mod_base = cm
  modified_base 2: mod_base = cm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
cctngngnancncnangngnancnancncnangncnangngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11451 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
agcnangngncntngngnancncncncntncngngntngncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11452 - RNA, 214 nt, synthetic construct
  source 1..214: mol_type = other RNA
  modified_base 1: mod_base = OTHER; note = 2'-O-Methyladenosine
  modified_base 2: mod_base = cm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 213^214: mod_base = OTHER; note = Phosphorothioate bond
  modified_base 212^213: mod_base = OTHER; note = Phosphorothioate bond
acancnangntngncntngnancngntncnancngngngngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11453 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
aggngngncnantntnantncntngngngncnantncncntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11454 - RNA, 214 nt, synthetic construct
  source 1..214: mol_type = other RNA
  modified_base 1: mod_base = um
  modified_base 2: mod_base = cm
  modified_base 3: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
  modified_base 212: mod_base = um
  modified_base 213: mod_base = um
  modified_base 214: mod_base = um
tctngngngncnantncncntnancnangngntntngncntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11455 - RNA, 214 nt, synthetic construct
  source 1..214: mol_type = other RNA
  modified_base 1: mod_base = gm
  modified_base 2: mod_base = cm
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gccnantncnancncntngncntngntnantncncncncngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11456 - RNA, 214 nt, synthetic construct
  source 1..214: mol_type = other RNA
  modified_base 1: mod_base = um
  modified_base 2: mod_base = cm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tcangncncngncncngngnangncntntngncncngngngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11457 - RNA, 214 nt, synthetic construct
  source 1..214: mol_type = other RNA
  modified_base 1: mod_base = gm
  modified_base 2: mod_base = um
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gtgngntngntncnancnangnanancntngncntntngnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11458 - RNA, 214 nt, synthetic construct
  source 1..214: mol_type = other RNA
  modified_base 1: mod_base = cm
  modified_base 2: mod_base = um
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
cttngnangnanangngncncnangngnanancntntngngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11459 - RNA, 214 nt, synthetic construct
  source 1..214: mol_type = other RNA
  modified_base 1: mod_base = cm
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
cgtngnancngntncnangncnancntngntngntngncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11460 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
aggncntncnanangntnangntnanangngntngntncncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11461 - RNA, 214 nt, synthetic construct
  source 1..214: mol_type = other RNA
  modified_base 1: mod_base = gm
  modified_base 2: mod_base = cm
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gccnancncnangncnangncncntngntngncnancncngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11462 - RNA, 214 nt, synthetic construct
  source 1..214: mol_type = other RNA
  modified_base 1: mod_base = OTHER; note = Phosphorothioate bond
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
agtngncncnangngngncnantnancnanancnancnangngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11463 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
aggngncnancngncntncngnantngntnangntnangntngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11464 - RNA, 214 nt, synthetic construct
  source 1..214: mol_type = other RNA
  modified_base 1: mod_base = um
  modified_base 2: mod_base = gm
  modified_base 3: mod_base = OTHER; note = 2'-O-Methyladenosine
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tganancnangngnantngnangncnangntngntncnancngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11465 - RNA, 214 nt, synthetic construct
  source 1..214: mol_type = other RNA
  modified_base 1: mod_base = OTHER; note = 2'-O-Methyladenosine
  modified_base 2: mod_base = gm
  modified_base 3: mod_base = um
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
agtngntncnancnantngngngncncntncnancntngncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11466 - RNA, 214 nt, synthetic construct
  source 1..214: mol_type = other RNA
  modified_base 1: mod_base = gm
  modified_base 2: mod_base = gm
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gggncncntncnancntngncntngnangngncntncncnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11467 - RNA, 214 nt, synthetic construct
  source 1..214: mol_type = other RNA
  modified_base 1: mod_base = cm
  modified_base 2: mod_base = OTHER; note = 2'-O-Methyladenosine
  modified_base 3: mod_base = cm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
cacnangngngncncncnancncntngngnangntngngngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11468 - RNA, 214 nt, synthetic construct
  source 1..214: mol_type = other RNA
  modified_base 1: mod_base = OTHER; note = 2'-O-Methyladenosine
  modified_base 2: mod_base = um
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
atgngntncnantngngntngntntncntntngncntngngngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11469 - RNA, 214 nt, synthetic construct
  source 1..214: mol_type = other RNA
  modified_base 1: mod_base = gm
  modified_base 2: mod_base = OTHER; note = Phosphorothioate bond
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gagncnantntnantnangncncntnanangncntncnancngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11470 - RNA, 214 nt, synthetic construct
  source 1..214: mol_type = other RNA
  modified_base 1: mod_base = cm
  modified_base 2: mod_base = um
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
ctgncncncncncnangngntnangnangncnangncngnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11471 - RNA, 214 nt, synthetic construct
  source 1..214: mol_type = other RNA
  modified_base 1: mod_base = gm
  modified_base 2: mod_base = OTHER; note = 2'-O-Methyladenosine
  modified_base 3: mod_base = gm
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
gagnangngnancncncnancnangncncncncnangngncngntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11472 - RNA, 214 nt, synthetic construct
  source 1..214: mol_type = other RNA
  modified_base 1: mod_base = um
  modified_base 2: mod_base = cm
  modified_base 3: mod_base = OTHER; note = Phosphorothioate bond
  modified_base 212: mod_base = um
  modified_base 213: mod_base = um
  modified_base 214: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 211^212: mod_base = OTHER; note = Phosphorothioate bond
  modified_base 212^213: mod_base = OTHER; note = Phosphorothioate bond
  modified_base 213^214: mod_base = OTHER; note = Phosphorothioate bond
tcangncncncnancngncntngntngncntngntntngnangntntngnangnanantncngnananangnantntncntntnanantnanangngncnantncncntntncncngnantngncntngnancntntncntncnancncngntncncngntntntntncncnanantnangngnangncngngngncngngntnantngntttt

SEQ ID NO: 11473 - DNA, 22 bp, synthetic construct
  source 1..22: mol_type = other DNA
gtggcccactcaacagcacagc

SEQ ID NO: 11474 - DNA, 22 bp, synthetic construct
  source 1..22: mol_type = other DNA
ccgctgtgccggaacctgcgcc

SEQ ID NO: 11475 - DNA, 22 bp, synthetic construct
  source 1..22: mol_type = other DNA
gccggaacctgcgcctggggct

SEQ ID NO: 11476 - DNA, 22 bp, synthetic construct
  source 1..22: mol_type = other DNA
tctcgctgctctacctgggggc

SEQ ID NO: 11477 - DNA, 22 bp, synthetic construct
  source 1..22: mol_type = other DNA
gggggcaggggtccctgtgagc

SEQ ID NO: 11478 - DNA, 22 bp, synthetic construct
  source 1..22: mol_type = other DNA
tacttcgtgaacatggccgtgg

SEQ ID NO: 11479 - DNA, 22 bp, synthetic construct
  source 1..22: mol_type = other DNA
ggcactggcacctgcgtacctg

SEQ ID NO: 11480 - DNA, 22 bp, synthetic construct
  source 1..22: mol_type = other DNA
tgttgggccctgcccactccag

SEQ ID NO: 11481 - DNA, 22 bp, synthetic construct
  source 1..22: mol_type = other DNA
gggccctgtggagcctcagcag

SEQ ID NO: 11482 - DNA, 22 bp, synthetic construct
  source 1..22: mol_type = other DNA
tgtgctcatcggctacgtggtg

SEQ ID NO: 11483 - DNA, 22 bp, synthetic construct
  source 1..22: mol_type = other DNA
aatcgggaaggaagacacaccc

SEQ ID NO: 11484 - DNA, 22 bp, synthetic construct
  source 1..22: mol_type = other DNA
acacccctggaccaggacacca

SEQ ID NO: 11485 - DNA, 22 bp, synthetic construct
  source 1..22: mol_type = other DNA
cctggaccaggacaccagcagg

SEQ ID NO: 11486 - DNA, 22 bp, synthetic construct
  source 1..22: mol_type = other DNA
agcaggctggacccctcggtgc

SEQ ID NO: 11487 - DNA, 22 bp, synthetic construct
  source 1..22: mol_type = other DNA
acacagtgctgacgtcacgggg

SEQ ID NO: 11488 - DNA, 22 bp, synthetic construct
  source 1..22: mol_type = other DNA
aggggcattatctgggcatcct

SEQ ID NO: 11489 - DNA, 22 bp, synthetic construct
  source 1..22: mol_type = other DNA
tctgggcatcctacaggttgct

SEQ ID NO: 11490 - DNA, 22 bp, synthetic construct
  source 1..22: mol_type = other DNA
gccatcacctgctgtatccccg

SEQ ID NO: 11491 - DNA, 22 bp, synthetic construct
  source 1..22: mol_type = other DNA
tcagccgccggagcttgccggg

SEQ ID NO: 11492 - DNA, 22 bp, synthetic construct
  source 1..22: mol_type = other DNA
gtggtgtcacagaactgcttga

SEQ ID NO: 11493 - DNA, 22 bp, synthetic construct
  source 1..22: mol_type = other DNA
cttgagaaggccaggaacttgg

SEQ ID NO: 11494 - DNA, 22 bp, synthetic construct
  source 1..22: mol_type = other DNA
cgtgacgtcagcactgtgtgcc

SEQ ID NO: 11495 - DNA, 22 bp, synthetic construct
  source 1..22: mol_type = other DNA
aggctcaagtagtaaggtgtcc

SEQ ID NO: 11496 - DNA, 22 bp, synthetic construct
  source 1..22: mol_type = other DNA
gccaccagcagcctgtgcaccg

SEQ ID NO: 11497 - DNA, 22 bp, synthetic construct
  source 1..22: mol_type = other DNA
agtgccagggcatacaacacag

SEQ ID NO: 11498 - DNA, 22 bp, synthetic construct
  source 1..22: mol_type = other DNA
agggcacgctcgatgtagtagt

SEQ ID NO: 11499 - DNA, 22 bp, synthetic construct
  source 1..22: mol_type = other DNA
tgaacaggatgagcagtgtcac

SEQ ID NO: 11500 - DNA, 22 bp, synthetic construct
  source 1..22: mol_type = other DNA
agtgtcacatgggcctcactgc

SEQ ID NO: 11501 - DNA, 22 bp, synthetic construct
  source 1..22: mol_type = other DNA
gggcctcactgctgaggctcca

SEQ ID NO: 11502 - DNA, 22 bp, synthetic construct
  source 1..22: mol_type = other DNA
cacagggcccacctggagtggg

SEQ ID NO: 11503 - DNA, 22 bp, synthetic construct
  source 1..22: mol_type = other DNA
atggtcatggtgttcttgctgg

SEQ ID NO: 11504 - DNA, 22 bp, synthetic construct
  source 1..22: mol_type = other DNA
gagcattatagcctaagctcac

SEQ ID NO: 11505 - DNA, 22 bp, synthetic construct
  source 1..22: mol_type = other DNA
ctgcccccaggtagagcagcga

SEQ ID NO: 11506 - DNA, 22 bp, synthetic construct
  source 1..22: mol_type = other DNA
gagaggacccacagccccaggc

SEQ ID NO: 11507 - DNA, 22 bp, synthetic construct
  source 1..22: mol_type = other DNA
tcagcccacgctgtgctgttga

SEQ ID NO: 11508 - RNA, 226 nt, synthetic construct
  source 1..226: mol_type = other RNA
  modified_base 1: mod_base = um
  modified_base 2: mod_base = gm
  modified_base 3: mod_base = gm
  modified_base 224: mod_base = um
  modified_base 225: mod_base = um
  modified_base 226: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 223^224: mod_base = OTHER; note = Phosphorothioate bond
  modified_base 224^225: mod_base = OTHER; note = Phosphorothioate bond
  modified_base 225^226: mod_base = OTHER; note = Phosphorothioate bond
tggncnancnangngncncncncnangnanangngnangntncntntngncncngngnananancngngncntnangnancnanangngngnanantncngncntntntntnancngncngnantntnancncncngncnanangngntnanangncncncngntncnangncnancncncntntngngntngntncngngncngngngncngnantncncntttt

SEQ ID NO: 11509 - RNA, 226 nt, synthetic construct
  source 1..226: mol_type = other RNA
  modified_base 1: mod_base = cm
  modified_base 2: mod_base = cm
  modified_base 3: mod_base = OTHER; note = 2'-O-Methyladenosine
  modified_base 224: mod_base = um
  modified_base 226: mod_base = um
  modified_base 225: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 223^224: mod_base = OTHER; note = Phosphorothioate bond
  modified_base 224^225: mod_base = OTHER; note = Phosphorothioate bond
  modified_base 225^226: mod_base = OTHER; note = Phosphorothioate bond
ccancntnangngngnancnangngnantntngngntngntncntntngncncngngnananancngngncntnangnancnanangngngnanantncngncntntntntnancngncngnantntnancncncngncnanangngntnanangncncncngntncnangncnancncncntntngngntngntncngngncngngngncngnantncncntttt

SEQ ID NO: 11510 - RNA, 226 nt, synthetic construct
  source 1..226: mol_type = other RNA
  modified_base 1: mod_base = OTHER; note = 2'-O-Methyladenosine
  modified_base 2: mod_base = gm
  modified_base 3: mod_base = gm
  modified_base 224: mod_base = um
  modified_base 225: mod_base = um
  modified_base 226: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 223^224: mod_base = OTHER; note = Phosphorothioate bond
  modified_base 224^225: mod_base = OTHER; note = Phosphorothioate bond
  modified_base 225^226: mod_base = OTHER; note = Phosphorothioate bond
aggnangnanancngngngngntngntncncnangngngntncntntngncncngngnananancngngncntnangnancnanangngngnanantncngncntntntntnancngncngnantntnancncncngncnanangngntnanangncncncngntncnangncnancncncntntngngntngntncngngncngngngncngnantncncntttt

SEQ ID NO: 11511 - RNA, 20 nt, synthetic construct
  source 1..20: mol_type = other RNA
tggcacaggccccagaagga

SEQ ID NO: 11512 - RNA, 20 nt, synthetic construct
  source 1..20: mol_type = other RNA
ccactagggacaggattggt

SEQ ID NO: 11513 - RNA, 20 nt, synthetic construct
  source 1..20: mol_type = other RNA
aggagaacggggtgtccagg

SEQ ID NO: 11514 - RNA, 288 nt, synthetic construct
  source 1..288: mol_type = other RNA
  modified_base 1: mod_base = gm
  modified_base 2: mod_base = OTHER; note = 2'-O-Methyladenosine
  modified_base 3: mod_base = cm
  modified_base 286: mod_base = um
  modified_base 287: mod_base = um
  modified_base 288: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 285^286: mod_base = OTHER; note = Phosphorothioate bond
  modified_base 286^287: mod_base = OTHER; note = Phosphorothioate bond
  modified_base 287^288: mod_base = OTHER; note = Phosphorothioate bond
gacnancncntntncntntncncncncnangncncncnangngntngntntntntnangntntncntncntngnantngnanananantncnangntnanangntntncntnanananantnanangngncnantntnantngncncngntngngngngntnantngngntngngntnantncncntncngntntncnananantnantncncnancncngntntntncntnananananananantncngncngncngncncngncncngngncngntngncntttt

SEQ ID NO: 11515 - RNA, 288 nt, synthetic construct
  source 1..288: mol_type = other RNA
  modified_base 1: mod_base = cm
  modified_base 2: mod_base = cm
  modified_base 3: mod_base = cm
  modified_base 286: mod_base = um
  modified_base 287: mod_base = um
  modified_base 288: mod_base = um
  modified_base 1^2: mod_base = OTHER; note = Phosphorothioate bond
  modified_base 2^3: mod_base = OTHER; note = Phosphorothioate bond
  modified_base 3^4: mod_base = OTHER; note = Phosphorothioate bond
  modified_base 285^286: mod_base = OTHER; note = Phosphorothioate bond
  modified_base 286^287: mod_base = OTHER; note = Phosphorothioate bond
  modified_base 287^288: mod_base = OTHER; note = Phosphorothioate bond
cccngngncncnancntntntncnangngnangngnangngnantngntntntntnangntntncntncntngnantngnanananantncnangntnanangntntncntnanananantnanangngncnantntnantngncncngntngngngngntnantngngntngngntnantncncntncngntntncnananantnantncncnancncngntntntncntnananananananantncngncngncngncncngncncngngncngntngncntttt

SEQ ID NO: 11516 - RNA, 24 nt, synthetic construct
  source 1..24: mol_type = other RNA
gacaccttcttccccagcccaggt

SEQ ID NO: 11517 - RNA, 24 nt, synthetic construct
  source 1..24: mol_type = other RNA
cccggccactttcaggaggaggat

SEQ ID NO: 11518-11554 - skipped (37 entries)

SEQ ID NO: 11555 - RNA, 103 nt, synthetic construct
  source 1..103: mol_type = other RNA
nnnnnnnnnnnnnnnnnnnnnnnngccgtggtgaaaaccacggtaaggtggttttccactgaaggttcttcgccccggcagcaatgccggggcgatccctttt

SEQ ID NO: 11556 - RNA, 121 nt, synthetic construct
  source 1..121: mol_type = other RNA
nnnnnnnnnnnnnnnnnnnngttgcgtattgacctagaaataggtcaatacgttaataagtaattatacttttatgtatttatttgcaaaaatggaaaaggcgtcttcggacgtctttttt

SEQ ID NO: 11557 - RNA, 114 nt, synthetic construct
  source 1..114: mol_type = other RNA
nnnnnnnnnnnnnnnnnnnngttgtagttccctgatgaaaatcaggttgctacaataaggtagtaaaccgaagagctctaacgccccgtttctttacggggcgttatctctttt

SEQ ID NO: 11558 - RNA, 116 nt, synthetic construct
  source 1..116: mol_type = other RNA
nnnnnnnnnnnnnnnnnnnnnnnngttatagttccctgttgaaaaagcaggttactatgataaggtagtacaccgcagagctccaacgcctcgcttttgcggggcgttgtctcttt

SEQ ID NO: 11559 - RNA, 116 nt, synthetic construct
  source 1..116: mol_type = other RNA
nnnnnnnnnnnnnnnnnnnnnnnngttgtagttccctggtgaaaatgcaggttgctatgataaggtagtacaccgcagagctctaatgccccgcatacgcggggcattatctctat

SEQ ID NO: 11560 - RNA, 116 nt, synthetic construct
  source 1..116: mol_type = other RNA
nnnnnnnnnnnnnnnnnnnngttatagttccctgatagaaatatttaggttactatgataaggtagtaaaccgaagagctctgacgcctcgctttttgcggggcgtcatctctttt

SEQ ID NO: 11561 - RNA, 114 nt, synthetic construct
  source 1..114: mol_type = other RNA
nnnnnnnnnnnnnnnnnnnngttatagttccctgatagaaatatttaggttactatgataaggtagtacacctaagagctctgacgcctcgcttttgcgaggcgttatctcttt

SEQ ID NO: 11562 - RNA, 119 nt, synthetic construct
  source 1..119: mol_type = other RNA
nnnnnnnnnnnnnnnnnnnnnnnngttgggaatcgaaagattcccaataagtcgttggccttcgggttgcaacgatgacttctcgccctccctccggctcagccggctcgggagggttt

SEQ ID NO: 11563 - RNA, 102 nt, synthetic construct
  source 1..102: mol_type = other RNA
nnnnnnnnnnnnnnnnnnnngttgggaatcgaaagattcccaataaggtgctggtcttcgggctgcagcatcgacttctcgccccctcctcggagggggttt

SEQ ID NO: 11564 - RNA, 104 nt, synthetic construct
  source 1..104: mol_type = other RNA
nnnnnnnnnnnnnnnnnnnnnnnngctgggaatcggaaacattcccagtaaggggcttcgagccctgacttctccagccctcgctcgcgggggcttcgttattt

SEQ ID NO: 11565 - RNA, 96 nt, synthetic construct
  source 1..96: mol_type = other RNA
nnnnnnnnnnnnnnnnnnnngctgggaagaaattcccagtaaggggcttcgagccctgacttctccagccctcgctcgcgggggcttcgttatttt

SEQ ID NO: 11566 - RNA, 126 nt, synthetic construct
  source 1..126: mol_type = other RNA
nnnnnnnnnnnnnnnnnnnnnnnngttgggaatgaaaattcccaataagggggcaaccccgacttctccagcatttatttgcttcgttttcaacaacctcggcttttgccgaggttgttgtgtttt

SEQ ID NO: 11567 - RNA, 108 nt, synthetic construct
  source 1..108: mol_type = other RNA
nnnnnnnnnnnnnnnnnnnngttgagaatcgaaagattcttaataaggcatccttccgatgctgacttctcaccgtccgttttccaataggagcgggcggtatgtttt

SEQ ID NO: 11568 - RNA, 101 nt, synthetic construct
  source 1..101: mol_type = other RNA
nnnnnnnnnnnnnnnnnnnngttgggaaccgaaaggttcccaataaggtacaaatcttcgtactgacttctcaccgtctagcctatcggctaggcggtttt

SEQ ID NO: 11569 - RNA, 121 nt, synthetic construct
  source 1..121: mol_type = other RNA
nnnnnnnnnnnnnnnnnnnngttgggaatcttgaaaaagtgttcctaacaagcttccacagcaatgtggatgttgatttatcagccgctgcaacccttcaagggtgcggcggctacgtttt

SEQ ID NO: 11570 - RNA, 98 nt, synthetic construct
  source 1..98: mol_type = other RNA
nnnnnnnnnnnnnnnnnnnngtcgggaatcgaaagattctcgacaagacgccttagggcgttgacctctacagtggacccgaaagggtccactttttt

SEQ ID NO: 11571 - RNA, 110 nt, synthetic construct
  source 1..110: mol_type = other RNA
nnnnnnnnnnnnnnnnnnnngttgggaatcgtgaaaacgattctcaacaagaggctttcgagtcttgatttctccatcccccgccggttcgccggtgggggattcgtttt

SEQ ID NO: 11572 - RNA, 115 nt, synthetic construct
  source 1..115: mol_type = other RNA
nnnnnnnnnnnnnnnnnnnngccgggaatcctcgctgaaaagcgaggcttcccgtcaaggtacttttcgtatctgacttattattcgccctcccttcggggagggcgaaacgttt

SEQ ID NO: 11573 - RNA, 108 nt, synthetic construct; identical to SEQ ID NO: 11567
  source 1..108: mol_type = other RNA

SEQ ID NO: 11574 - RNA, 108 nt, synthetic construct; identical to SEQ ID NO: 11567
  source 1..108: mol_type = other RNA

SEQ ID NO: 11575 - RNA, 112 nt, synthetic construct
  source 1..112: mol_type = other RNA
nnnnnnnnnnnnnnnnnnnngttgagaatcttgaaaaagattcttaataaggcatccttccgatgctgacttctcaccgtccggctcctcttaggaacgggcggtatgtttt

SEQ ID NO: 11576 - RNA, 100 nt, synthetic construct
  source 1..100: mol_type = other RNA
nnnnnnnnnnnnnnnnnnnngtttcaatgaaaattgaaataagcgatttcgtatcgcggaattctccagcccctcggttttaccggggggcttcgttttt

SEQ ID NO: 11577 - RNA, 123 nt, synthetic construct
  source 1..123: mol_type = other RNA
nnnnnnnnnnnnnnnnnnnngttgtagttccctgatgaaaatcaggttactacaataaggcccggctgagagccggtgccgcaaagctctaacggcgtgtcttcggacacgccgttatctttt

SEQ ID NO: 11578 - RNA, 102 nt, synthetic construct
  source 1..102: mol_type = other RNA
nnnnnnnnnnnnnnnnnnnnnnnngttgtaattccctaatgaaaattaggttattacaataaggtctagctgttagctagcaccgtaaagctctaacggctt

SEQ ID NO: 11579 - RNA, 131 nt, synthetic construct
  source 1..131: mol_type = other RNA
nnnnnnnnnnnnnnnnnnnnnnnngttgtagctccctgatgggaaaccatttggttgctgcaataaggcagtacgccgaaaagctctgatagcccgacgtatgttgggctatcatctttatagggtatttt

SEQ ID NO: 11580 - RNA, 100 nt, synthetic construct
  source 1..100: mol_type = other RNA
nnnnnnnnnnnnnnnnnnnnnnnngttgtagtgaaaactatgataaggtagtataccgcaaagctctgacacctcatcttcggatggggtgttatctttt

SEQ ID NO: 11581 - RNA, 116 nt, synthetic construct
  source 1..116: mol_type = other RNA
nnnnnnnnnnnnnnnnnnnnnnnngttgtagttccctaatgaaaattaggttactatgataaggtagtataccgcaaagctctgacgctccgtcttttggcggagcgtcatctttt

SEQ ID NO: 11582 - RNA, 119 nt, synthetic construct
  source 1..119: mol_type = other RNA
nnnnnnnnnnnnnnnnnnnnnnnngttatagttccctaatgaaaattaggttgctataataaggtagcaaaccgtaaagctctgatgccctattcattttgaatagggcattatctttt

SEQ ID NO: 11583 - RNA, 119 nt, synthetic construct
  source 1..119: mol_type = other RNA
nnnnnnnnnnnnnnnnnnnnnnnngttgtagttccctaattgaaaaattaggttactatgataaggtcgtagtaccgcaaagctctaatgccccgtcttttgacggggcattatctttt

SEQ ID NO: 11584 - RNA, 115 nt, synthetic construct
  source 1..115: mol_type = other RNA
nnnnnnnnnnnnnnnnnnnnnnnngttgtagttccctaatgaaaattaggttactatgataaggtagtataccgcaaagctctaacaccctgcttttggcagggtgttatctttt

SEQ ID NO: 11585 - RNA, 99 nt, synthetic construct
  source 1..99: mol_type = other RNA
nnnnnnnnnnnnnnnnnnnnnnnngttgtagtgaaaactatgataaggtagtataccgcaaagctctaacgccccgtctttgacggggcgttatctttt

SEQ ID NO: 11586 - RNA, 121 nt, synthetic construct
  source 1..121: mol_type = other RNA
nnnnnnnnnnnnnnnnnnnnnnnnggttgtagttccctaattggaaacaatcaggttactatgataaggtagtataccgcaaagctctaacacctcatcttcggatggggtgttatctttt

SEQ ID NO: 11587 - RNA, 114 nt, synthetic construct
  source 1..114: mol_type = other RNA
nnnnnnnnnnnnnnnnnnnnnnnngttgtagttccctgcagaaatgcgggttgctgcaataaggtagcaaaccgcaaagctctgatagcccaactttgttgggctatcatcttt

SEQ ID NO: 11588 - RNA, 116 nt, synthetic construct
  source 1..116: mol_type = other RNA
nnnnnnnnnnnnnnnnnnnnnnnngttgtagttcccttttcgaaggaaaactatgataaagtagtacactgcaaagctctgatgccttgttcatttagaacagggcatcatctttt

SEQ ID NO: 11589 - RNA, 130 nt, synthetic construct
  source 1..130: mol_type = other RNA
nnnnnnnnnnnnnnnnnnnnnnnngttgtaattccctattgaaaaataggttattacaataaggtctggtgatgcaacaagtaccgcaaagccctaacggcctgcctttactggcaggtcgttatctttt

SEQ ID NO: 11590 - RNA, 115 nt, synthetic construct
  source 1..115: mol_type = other RNA
nnnnnnnnnnnnnnnnnnnnttgtaattccctagaaataggttattacaataaggtccaacaggagtgttggtaccgtaaagctctaacggcacccacgggtgccgttatctttt

SEQ ID NO: 11591 - RNA, 115 nt, synthetic construct
  source 1..115: mol_type = other RNA
nnnnnnnnnnnnnnnnnnnnnnnngttgtagttccctaatttagaaataaaataggttattacaataaggtccggctgcgaggccggaaccgcaaagctctgacggcctgccttt

SEQ ID NO: 11592 - RNA, 117 nt, synthetic construct
  source 1..117: mol_type = other RNA
nnnnnnnnnnnnnnnnnnnngttgtagttccctattgaaaaataggttactgcaataaagcccttgtgaaagcatggtgctgtaacccgaaagtgccgcgcttgtcgcggcgctttt

SEQ ID NO: 11593 - protein, 1087 aa, synthetic construct
MNYVLGLDVGITSCGWAVLELNHEDEPVRIVDLNSRIFDKAEAPKTGESLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFRDCKRNKGGTYRFTVSRSMLKEEVQTLFKKQRELGQTFAGEDLEDEYISIFSAQRNFDEGPGANSPYAGDQIEKMIGDCTFEDGKNGRPPQKRAPKASYAFMAFNLWQKINHIRVNCKGIERSLETEEKNKIAGLAWTKENITYHDLRQITGLDEETRFSGVTYPLDSTTEEAEKKVKFSWVKPYHAMRRALDKVEKNYIQKLSREEIDAIAYAFTVYKNDKKIRTALTEKGIEDNVADVLITHLDGFSKFGHLSEYACYKLLPFLEKGEEYYKACESAGYDFRKSSMEKLEDIPNPVVKRAVTQTMKVIKAVQRKYGNPVEVHIELARELARSFKDRAAMDDRMKENHAKNEEIKEYLSKELHVMSPTGQDIVKWKLYKQQQGSCAYSQKPFDVDKLLHDRTYAEVDHILPYSRSFDDTYRNKVLVLTKENRDKGNRTPMEYLADKPERKEKFIVWVKTVIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENETWIDDHTKVDERTGEIFFVKKAHEKDAFPEPWPRFRQELEARVSEDPEEAIRRLHLPAYENVRDIKKPFVSRMPRRKVRGAAHKETVRSGKLREDGYTILKTDLSALKLKNGEIEGYYRPESDRLLYEALKKRLEAFGGKGKEAFKEPFHKPKADGTPGPLVKKVKIIEKSSLNVPVHKGKGVAYNDTMVRIDIFGVNEKGKNAYYFVPVYVSDTVKKELPCRAVVQGKSYENWKVMDDKDFLFSLYPNDMIHVVAKRDLSFTASEESSLAATMETKNIYVYYKAADIAAGNIKVITHDNSYEKRGFGIKTLLQLEKCEVDVLGNIFLVKQEKRQGFR

SEQ ID NO: 11594 - protein, 1079 aa, synthetic construct
MNYVLGLDVGITSCGWAVLELNHEDEPVRIVDLNSRIFDKAETPKTGESLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYWFTVSRSMLKEEVQTLFKKQRELGQTFAGEDLEDEYISIFSAQRNFDEGPGANSPYAGDQIEKMIGNCTFEDGKNDRPPQKRAAKASYAFMAFNLWQKINHIRVNCKGIERSLETEEKNKIAGLAWTKENITYHDLRQITGLDEETRFSGVTYPLDSTTEEAEKKAKFSWVKPYHAMRRALDKVEKNYIRKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDDRMKENHAQNEAIKEYLSKELHVMSPTGQDIVKWKLYKQQQGSCAYSQKPFDIDKLLHDRTYAEVDHILPYSRSFDDTYRNKVLVLTKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENVKLIDKETGEVLTAKEFHNKDNFPEPWPRFRQELEARVSEDPEEAIRRLCLPAYENAGEIKKPFVSRMPRRKVRGAAHKETVRSGKLREDGYTILKTDLSALKLKNGEIEGYYRPESDRLLYEALKKRLEAFGGKGKEAFKEPFYKPKADGTPGPLVKKVKIIEKSSLNVPVHKGKGVAYNDTMVRIDIFGVNEKGKNAYYFVPVYVSDTVKKELPCRAVTRGKSYENWKIMDDKDFLFSLYPNDMIHVVAKKPFSFTAAEGADLAPTVETKDTCVYYKGADIKGGSITVINHDNSYGIKSMGIKTLLQLEKCEVGVLGNISFVKQEKRQGFR

SEQ ID NO: 11595 - protein, 1085 aa, synthetic construct
MNYVLGLDVGITSCGWAVLELNHEDEPVRIVDLNSRIFDKAEAPKTGESLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGDCTFEDGKNDRPPQKRAPKASYAFMAFNLWQKINHIRVNCKGIERSLETEEKNKIAGLAWTKENITYHDLRQITGLDEETRFSGVTYPLDSTTEEAEKKVKFSWVKPYHAMRRALDKVEKNYIQKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKERFIAWVKTTIKDSKKREHLLRVKYGRDEEAEWKQRHLQDTQYISRFLYNYLRNTLELAPGYTDRKRRIIPVNGAVTGYIRKRLDIRKIRENGDLHHAVDAVVIAATTQGMIQKVTRYSQIKENETWIDDHTKVDERTGEIFFVKKAHEKDAFPEPWPRFRQELEARVSEDPEEAIRRLGLPSYENAGEIKKPFVSRMPRRKVRGAAHKETVRSGKLREDGYTILKTDLSALKLKNGEIEGYYRPESDRLLYEALKKRLEAFGGKGKEAFKEPFYKPKADGTPGPLVKKVKIIEKSSLNVPVHKGKGIAYNDTMVRIDIFGVNEKGKNAYYFVPVYVSDTVKKELPCRAVVSKKPYEEWKVMDDKDFLFSLYPNDMIHVVAKTPLSFTVAEGADLAPTMETKDTYVYYKKAAISVGTITVITHDNSYGIKSMGIKTLLQLEKCEVDVLGNISFVKQEKRQGFR

SEQ ID NO: 11596 - protein, 596 aa, synthetic construct
GKGIQRSLETEEKNKIADLAWTKENITYHDLRQITGLDEETRFSEVTYPLDSTTEEAEKKVKFSWVKPYHAMRRALDKVEKNYIWKLSRGEIDAIAYAFTVYKNDKKIRIALTEKGIEENVADVLITHLDGFSKFGHLSEYACYKLLPFLEKGEEYYKACESAGYDFRKSSMEKLEDIPNPVVKRAVTQTMKVVKAVQRQYGNPVEVHIELARELARSFKDRAAMDDRMKENHAKNEVIKEYLSKELHVMSPTGQDIVKWKLYKQQQGSCAYSQKPFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENVKLIDKETGEVLTAKEVHNKDNFPEPWPHFWQELNARVSENPEEAIRRLRLPAYENVGEIKKTFVSRMPRRKVRGAAHEETVRSGKLREDGYTILKTDLSKLKLENGEIKGYYRPESDRLLYEALKKRLEAFGGKGE

SEQ ID NO: 11597 - protein, 885 aa, synthetic construct
MNYVLGLDVGITSCGWAVLELNHEDEPVRIVDLNARIFDKAEAPKTGESLAAPRRMARGIRRLTRRRKFRLHRVRGFLVRHHILTKEEIENLYTNPHKTDIYELRYRALTEKVSPSDWARLLIFFAKHRGFQSNRKNEKSGEDGLMLAAIGENKKILENYRSVGDMLYSDEKFIGCKRNKGGTYRFTVSRSMLKEEVQTLFKKQRELGQTFAGEDLEDEYLSIFSAQRNFDEGPGANSPYAGDQIEKMIGDCTFEDGKNGRPPQKRAPKASYAFMAFNLWQKINHIRVNGKGIQRSLETEEKNKIADLAWTKENITYHDLRQITGLDEETRFSEVTYPLDSTTEEAEKKVKFSWVKPYHAMRRALDKVEKNYIWKLSRGEIDAIAYAFTVYKNDKKIRIALTEKGIEENVADVLITHLDGFSKFGHLSEYACYKLLPFLEKGEEYYKACESAGYDFRKSSMEKLEDIPNPVVKRAVTQTMKVVKAVQRQYGNPVEVHIELARELARSFKDRAAMDDRMKENHAKNEVIKEYLSKELHVMSPTGQDIVKWKLYKQQQGSCAYSQKPFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENVKLIDKETGEVLTAKEVHNKDNFPEPWPHFWQELNARVSENPEEAIRRLRLPAYENVGEIKKTFVSRMPRRKVRGAAHEETVRSGKLREDGYTILKTDLSKLKLENGEIKGYYRPESDRLLYEALKKRLEAFGGKGE

SEQ ID NO: 11598 - protein, 884 aa, synthetic construct
MNYVLGLDVGITSCGWAVLELNPEDEPVRIVDLNSRIFDKAEAGNGDSLAAPRRMARGIRRLTRRRKFRLHRVRGFLVRHHILTKEEIENLYTTPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYLSIFSAQRNFDEGPGANSPYAGDQIEKMIGDCTFEDGKNGRPPQKRAPKASYAFMAFNLWQKINHIRVNGKGIQRSLETEEKNKIADLAWTKENITYHDLRQITGLDEETRFSEVTYPLDSTTEEAEKKVKFSWVKPYHAMRRALDKVEKNYIWKLSRGEIDAIAYAFTVYKNDKKIRIALTEKGIEENVADVLITHLDGFSKFGHLSEYACYKLLPFLEKGEEYYKACESAGYDFRKSSMEKLEDIPNPVVKRAVTQTMKVVKAVQRQYGNPVEVHIELARELARSFKDRAAMDDRMKENHAKNEVIKEYLSKELHVMSPTGQDIVKWKLYKQQQGSCAYSQKPFDVDKLLHDRTYAEVDHILPYSRSFDDTYRNKVLVLTKENRDKGNRTPMEYLADKPERKEKFIAWVKTTIKDSKKREHLLRVKYGRDEEAEWKQRHLQDTQYISRFLYNYLRNTLELTPGYTDRKRRIIPVNGAVTGYIRKRLGIHKIRENGDLHHAVDAVVIAATTQGMIQKVTRYSQIKENVKLIDKETGEVLTAKEVHNKDNFPEPWPHFWQELNARVSENPEEAIRRLRLPAYENVGEIKKTFVSRMPRRKVRGAAHEETVRSGKLREDGYTILKTDLSKLKLENGEIKGYYRPESDRLLYEALKKRLEAFGGKGE

SEQ ID NO: 11599 - protein, 1078 aa, synthetic construct
MNYVLGLDVGITSCGWAVLELNHEDEPVRIVDLNSRIFDKAEAGNGDSLAAPRRMARGIRRLTRRRKFRLHRVRGFLVRHHILTKEEIENLYTNPHKTDIYELRYRALTEKVSPSDWARLLIFFAKHRGFQSNRKNEKSGEDGLMLAAIGENKKILENYRSVGDMLYSDEKFKDCKRNKGGTYRFTVSRSMLKEEVQTLFKKQRELGQTFAGEDLEDEYISIFSAQRNFDEGPGANSPYAGDQIEKMIGNCTFEDGKNDRPPQKRAPKASYAFMAFNLWQKINHIRVNCKGIERSLETEEKNKIADLAWTKENITYHDLRQITGLDEETRFSGVTYPLDSTTEEAEKKVKFSWVKPYHAMRRALDKVEKNYIRKLSREEIDAIAYAFTVYKNDKKIRTALAEKGIEDNVADVLITHLDGFSKFGHLSEYACYKLLPFLEKGEEYYKACDSAGLTESPAKKIKDITNPVVKRAVTQTMKVIKAVQRKYGNPVEVHIELARELARSFKDRAAMDHRMKENYAKNEKIKERLSKEFHIMNPRGQDIVKWKLYEQQQGCCAYSQKPFDVDRLLHDGNYAEVDHILPYSRSFDDTYRNKVLVLEKENRDKGNRTPMEYLADKPERKERFIAWVKTTIKDSKKREHLLRVKYGRDEEAEWKQRHLQDTQYISRFLYNYLRNTLELAPGYTDRKRRIIPVNGAVTGYIRKRLDIRKIRENGDLHHAVDAVVIAVTTQGMIQKVTRYSQIRENVKLIDKETGEVLTAKEVHNKDNFPEPWPRFRQELEARVSEDPEEAIRRLRLPSYENVGEIKKPFVSRMPRRKVRGAAHKEIIRSGKLREDGYTILKTDLSALKLKNGEIKGYYRPESDRLLYEALKKRLEDFGGKGKEAFKTPFYKPKADGTPGPLVKKVKIIERSSLNVPVHKGKGVAYNDTMVRIDIFGVNEKGKTAYYFVPVYVSDTVKKELPCRAVVANKPYEEWLVMDDTDFLFSLYPNDMIHVVAKRDLSFTAAEGADLAPKMETKDTCVYYKAADISTGSILVITHDNSYEKRGLGIKTLLQLEKCEVDVLGNISLVKQEKRQGFR

SEQ ID NO: 11600 - protein, 1086 aa, synthetic construct
MNYVLGLDIGITSVGWAVLELDTHDEPIRIVDLNSRIFEKAEVPKTGESLAAPRRIARSARRLTRRRRFRLHRVRRYLIRNDILDEQQVAVLYDDSAGKTDIYELRYQALSQPVSNSDWARLLIFFAKHRGFKSNRKHISDGGDEGQMLNAITENQELLKNYRTVGEMLYKNEKFKACKRNKGGSYTFTVSRAMLADEIHILFDVQRNLGQAYASEKLEEEYMELFSAQRNFDEGPGINSPYSGNQIEKMIGSCTFEDGEKRAPKASYAFMAFNVWQKINHLRVTCEGTYRFLSQEEKETLAALTWKKENITFKDIRNKLGLDDTIRFLDVNYNLDKYKTTEEAEKKVKFSWVKEYHAIRKALDKVKKNRISELSHEQIDAIAYAFTVYKNDEAIKSYLLEHAIKRVDAEALLKNISGFSKFGHLSVKACYKLLEPLKQGNVYTKACEIAGYDPQKSSQGNISDIPNPVVKRALSQALKVIKAIIRQYGCPPVEIHIELARELAKSAKERTELEKAMKDNQSRNEKIKTKLHELNVMQPTGLDIVKYKLYEQQQGDCAHSQKKFDVNRLLHDPTYAEVDHIIPYSRSFDDTYRNKVLVLTKENRDKGNRTPMEYFQDKPERKEAFVRWVKRTISDGKKRNNLLRVNYSADAEKEWKDRHLQDTQYISRYLYNYLRQHVPLKEGYTDRKRRIIPVNGAVTAYVRKRLGISKIRENGDLHHAVDAVIIACVTQGVVNKISRYSKIKELRQFMTADGTIVDKETGEVLQTANPRKTDPFPEPWPKFRQELEARVSDNPEEAIAALELPTYEGIVTISALFVSRMPNRKVHGPAHMETIRSAKMQQDGYTMVKTDLTNLKLKDGEIEGYYNPSSDKILYDALKRRLEQFGGDGNKAFKDPFYKPKSDGTPGPEVKKVKIMTKSSLNVTVNQGKGIADNGSMIRIDVFGVEERGKNAYYFVPIYVADTVKETLPNKAVVPNKSYNDWKFMRDEDFLFSLYPNDLIYVESPTPVSFHTVKGCTLPPKIERKKMFLYYRKANISTASITVLNHDNTYVKESMGIKTIAKLQKCTVDVLGNIHYVQKEKRLGFK

SEQ ID NO: 11601 - protein, 1086 aa, synthetic construct
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQPVSNSDWARLLIFFAKHRGFKSNRKHISDSGDEGQMLNAITENQEILNNYHTVGEMLYKNEKFKACKRNKGGSYAFTVSRDMLADEIHALFDVQRSLGQAYASEKLEEEYMELFSAQRNFDEGPGMNSPYSGNQIEKMIGCCTFEDGEKRAPKASYAFMAFNVWQKINHLRVTCEGTDRSLSQAEKETLAALAWKKENITFKDIRNKLGLDDTVRFLDVNYNLDKYKTAEEAEKKVKFSWVKEYHAIRKALDKVKKDRISELSHEQIDTIAYAFTVYKNDEAIKRYLLEHAIELADAEALLENISGFSKFGHLSVKACYKLLEPLQQGHVYTKACEIAGYDPQKSNQENINDIPNPVVKRALSQALKVIKAIIRQYGCPPVEIHIELARELAKSAKERTELEKAMKDNQSRNEKIKTKLHELNVMQPTGLDIVKYKLYEQQQGDCAYSQKKFDVNCLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELKEGYTDRKRRIIPVNGAVTAYVRKRLGISKIRENGDLHHAVDAVIIACVTQGVVNKISRYSKIKELRQFMTADGTVVDKETGEVLQTANSRKTDPFPEPWPKFRQELEARVSDNPAEAIAALGLPTYKGIVNISAPFVSRMPNRKVHGPAHMETIRSAKMQQDGYTMVKTELTNLKLKDSEIEGYYNPSSDKILYDALKRRLEQFGGDGNKAFKDPFYKPKSDGTPGPEVKKVKIMTKSSLNVAVNQGKGVADNGSMVRIDVFGVEERGKNAYYFVPIYVADTVKETLPNRAVTRGEPYNNWKIMKDEDFLFSLYPNDLIYIESLSPVSFHTVKGCTLVPKIERKEMLLYYRKAGISTASITVLNHDNTYVKESLGIKTIGKLQKCTVDILGNVHYVQKEKRVGFK

SEQ ID NO: 11602 - protein, 1084 aa, synthetic construct
MNYVLGLDIGITSVGWAVLELDTHDEPIRIVDLNSRIFEKAEVPKTGESLAAPRRMARSARRLTRRRRFRLHRVRRYLIRNRILDARQVEELYVDSIGKTDIYELRYQALSQPVSNSDWARLLIFFAKHRGFKSNRKHISGSGDEGQMLNAITENQEILKNYRTVGEMLYKNEKFKACKRNKGGSYTFTVSRAMLADEIHTLFDVQRNLGQAYASEKLKEEYMELFSAQRNFDKGPGINSPYSGNQIEKMIGSCTFEDGEKRAPKASYAFMAFNVWQKINHLRVTCEGTYRFLSQTEKETLAALAWKKENITFKDIRRELKLDDTVRFLDVNYNLDKYKEEAEKKVKFSWVKEYHAIRKALDKVKKDRISELSHEQIDTIAYAFTVYKNDEAIKRYLLEHAIELADAEALLENISGFSKFGHLSVKACYKLLEPLQQGHVYTKACEIAGYDPQKSNQENINDIPNPVVKRALSQALKVIKAIIRQYGCPPVEIHIELARELAKSAKERTELEKAMKDNQSRNEKIKTKLHELNVMQPTGLDIVKYKLYKQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYISRYLYNYLKRHIELNEGYTDRKRRIIPVNGAVTAYVRKRLGISKIRENGDLHHAVDAVIIACVTQGVVNKISRYSKIKELRQFMTADGMIVDKETGEVLQTTNPRKTDPFPEPWPKFRQELEARVSDNPAEAIAALGLPTYKGIVNISAPFVSRMPNRKVHGPAHMETIRSAKMQQDGYTMVKTELTNLKLKDGEIEGYYNPSSDKILYDALKRRLEQFGGDGNKAFKDPFYKPKSDGTPGPEVKKVKIMTKSSLNVAVNQGKGVADNGSMVRIDVFGVEERGKNAYYFVPIYVADTVKETLPNRAVTRGEPYNNWKIMKDEDFLFSLYPNDLIYIESLSPVSFHTVKGCTLVPKIERKEMLLYYRKAGISTASITVLNHDNTYVKESLGIKTIGKLQKCTVDILGNVHYVQKEKRVGFK

SEQ ID NO: 11603 - protein, 703 aa, synthetic construct
MSHEQLDTIATAFSVYKNEEMIEKYLEEGGIEKADREALLERLSGFSKFGHLSLKACYKILPFLEKGEVYSRACERAGYDFRKSSLENINDIPNPVVKRSISQTLKVINAIILRYGNPVEVHIELARELAKNFRDRKKMEKGMQENQAKNEKIRQRLMSEFGVLRPKGMDIVKFKLCEEQNGECAYSQKHFDMEKLLRDPSYAEVDHIIPYSRSFDDSYNNKVLVLTKENREKRNRIPMEYLADATERKNRFIHWVKSTIRNSRKRENLLRTDYTETTENEWKRRNLQDTQYISKYLYNYLRHHLVPAKGYTERKRRIIPVNGAVTAYIRKRLGINKIRENGDLHHAVDAVIIACATQGIVNKVSRYSKSRELWDYEVDMETGEVLQKKNENRKDIFPEPWLNFRYELEQKVRVRPLDIPETADITEMEEPFVSHMPNRKIHGPAHKETIRSGRLKEEGYTISKTALTDLKLTEDKEEIKGYYNKESDRLLYEALKKQLQRYSGKAKEAFKEPFHKPKADGTPGPIVNKVKIMEKSTMPVPVNGGKGLASNGNMVRIDVFRVEEKGKKKYYFIPVYVADTVKEELPNRAVLAHKPYEAWKIMKEEDFIFSLYPNDLIFVDAGKEIPFKAALKGSTLDPEKKASRFLMYYKGADIAGGTINGVNHDSTYGIRIGLQRLKGIRKCRIDVLGNISLVGKERRKTFR

SEQ ID NO: 11604 - protein, 582 aa, synthetic construct
IELARELARSFRDRKKMEKGMQENQAKNEKIRQRLISEFGVLRPKGMDIVKFKLCEEQNGECAYSQKHFDMEKLLKDPSYAEVDHIIPYSRSFDDSYNNKVLVLTKENREKRNRIPMEYLADAPERKNRFIHWVKSTIRNSRKRENLLRTDYTATTENEWKRRNLQDTQYISKYLYNYLRHHLVLAKGYTERKRRIIPVNGAVTAYFRKRLGINKIRENGDLHHAVDAVIIACATQGIVNKVSRYSKSRELWDYEVDMETGEVLQKKNKNTKDVFPEPWLNFRYELEQKVRVRPLDIPETADITEMEEPFVSHMPNRKIHGPAHKETIRSGRLKEEGYTISKTALIDLKLTEDKEEIKGYYNKESDRLLYEALKKQLQRYGGKAKEAFKEPFHKPKADGTPGPIVNKVKIMEKSTMLIPVNGGKGLASNGNMVRIDVFRAEEKGKKKYYFIPVYVADTVKEELPNRAVLAHKPYEAWKIMKEEDFIFSLYPNDLIFVDAGKEIPFKAALKGSTLDPEKKASRFLMYYKGADIATGSISGVNHDETYKARGVGIQSLREIKKCCIDVLGNISFASKEKRQTFR

SEQ ID NO: 11605 - protein, 1103 aa, synthetic construct
MDTKELKYVVGLDIGIASVGWATLLLDSQDEPVRILDLNSRIFDKAEVPKTGASLAAPRRMARGGRRRLRRRKFRLHRVRQYILRHHILDKVGLECLYKPKTDIDIFALRTAGLDRLLEPEEWARILLYMAKHRGFKSNRKSAAVAGGDDGVMLDAIRKNKEVLSKYRSVGEMFDKDEKFSAHKRNKGGSYEFTVARSMLEDEIKLLFEKQRDFGSAFAEKDAEEEYIELFSAQRNFDEGPGGDSPYGGNQIEKMIGLCTFEGKNGEKRAPKASYAFMATNLWQKINQIRIIEKGTERPLTAEEAGKIDEKAWKKGAMTYKDIRSEISLGDEAYFKGLSYKWTETDKEETESKVKFSLVKEYHTLRKVLDKVEKNRILQLSHDDIDNIAYIFSVYKNDDKIREALEETDLDSKDIDVLIEHLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKQRKRENLLREKFTADAENDWKARHLQDTQYISRFMLNYLQNNYELTPGNTDRKRRIIPVNGAVTAYVRKRLGISKIRENGDLHHAVDATVIAAVTQGVVNSVSKYSKRHELQYHVDEHGNCVDLVTGKLMGDAFKENHKIKGFPEPWPQFRAELEARVSENAAEAIRTLNLPTYSSDEEIKTPFVSRMVRHKTTGQAHEDTVRGKSNVADNEYVKKVALTELKLKDGEIEGYYNRPSDRLLYEALKKRLEQFGGKGKDAFKEPFYKPKSDGSPGPIVKKCKILDKINLAVQVHGGKGATANANGSMIRVDIFKAKEKNGKYSYYAVPIYVADTVKEELPNKAVCNKEYNRWPKMKEEDFAFSLYPNDVVYIGGKEIKMNAAPGCTLETTRSIQDVNLYFRGMDISTGAIRVVNHDGTYKQKSLGIKQLPLIEKYEVSVLGDLVKAIYKPRETFKHKVRRSK

SEQ ID NO: 11606 - protein, 734 aa, synthetic construct
KVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQAMKVLKAIKKKCVCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKVRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFYKPKSDGSLGPIVKKCKVIDKISLAVPVHGGKGATANANGSMIRVDIFRVKEKNNKHSYYAVPIYVADTVKDKLPNKAIVAKKNYDEWLEMKKEDFVFSLYPNSAVYIGGKDIKMNVISGCTLELEKTMRDTILYYKGLDISPGALKIINHDGTYQQRGLGIKSLPFIEKYEVSVLGDLVKATYRPRETFNHKAQRSK

SEQ ID NO: 11607 - protein, 875 aa, synthetic construct
LFSAQRNFDEGPGGDSPYGGNQIEKMIGLCTFEGKNGEKRAPKASYAFMATNLWQKINQIRIIEKGTERPLTAEEAGKIDEKAWKKEAMTYKDIRSEIGLGDEASFKGLPYKWTETDKEETESKAKFSWVKEYHTLRKVLDKVEKNRILQLSHDDIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQAMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKVRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFYKPKSDGSLGPIVKKCKVIDKISLAVPVHGGEGATANANGSMIRVDIFRVKEKNNKHSYYAVPIYVADTVKDKLPNKAIVAKKNYDEWLEMKKEDFVFSLYPNSAVYIGGKDIKMNVISGCTLELEKTMRDTILYYKGLDISPGALKIINHDGTYQQRGLGIKSLPFIEKYEVSVLGDLVKATYRPRETFNHKAQRSK

SEQ ID NO: 11608 - protein, 1103 aa, synthetic construct
MDTKELKYVVGLDIGITSVGWATLLLDSQDEPVRILDLNSRIFDKAEVPKTGASLAAPRRMARGVRRRLRRRKFRLHRVRQYILRHHILDKAGLECLYKPKTDIDIFALRTAGLDRLLEPEEWARILLYMAKHRGFKSNRKSAAVAGSDDGVMLKAIQQNKEVLSKYRSVGEMFDKDEKFSDHKRNKGGSYEFTVARSMLEDEIKLLFEKQRDFGSAFAEKDAEEEYIDLFSAQRNFDEGPGGDSPYGGNQIEKMIGLCTFEGKNGEKRAPKASYAFMATNLWQKINQIRIIEKGTERPLTAEEAGKIYEKAWNKEAMTYKDIRSEISLGDEASFKGLPYKWTETDKEETEGKAKFSWVKEYHTLRKVLDKVEKNRILQLSHDDIDNIAYIFSVYKNDDKIREALEETDLDSKDIDVLIEKLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENEWKVRHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKIIDKINLSVPVHGGKGATANANGSMIRVDIFKVQEKNGKHSYYSVPIYVADTVKSELPKKAVYRRPYDEWPEMKEADFAFSLYPNDAIYIGGKEIKMTAMPGCTLAIENHVKDDFFYYKGFDIATGAMIVINHDGTYKQRGVGIKQLPLIEKYEVSVLGDLVKAMYRPRETFKHKAQRSK

SEQ ID NO: 11609 - protein, 510 aa, synthetic construct
LHDGNYAEVDHILPYSRSFDDTYRNKVLVLEKENRDKGNRTPMEYLADKPERKEKFIAWVKTVIKDSKKREHLLRMKYGRDEEAEWKQRHLQDTQYISRFLYNYLRNTLKLAPGYTDRKRRIIPVNGAVTGYIRKRLDIRKIRENGDLHHAVDAVVIAVTTQGMIQKVTRYSQIRENPKLIDKKTGEVLTAKEFHNKDNFPEPWPRFRQELEARVSEDPEEAIRRLRLPAYENVGEIKKPFISRMPRRKVRGAAHEETVRSGKLREDGYTILKTDLSKLKLENGEIKGYYRPESDRLLYEALKKRLEAFGGKGEEAFKEPFYKPKADGTPGPLVKKVKIIEKSSLNVPVHKGEGVAYNKIRIRIDIFGVNEKGKMAYYFVPVYVSDTVKRELPCRAVVQDKSYENWKMMDDKDFLFSLYPNDMIHVVAKRDLSFTAAEGSSLAPKIKTKDAYVYYKGADINGGTITVINHDNSYGIKSMGIKTLLQMEKCEVDILGNISVVKQEKRQGFR

SEQ ID NO: 11610 - protein, 735 aa, synthetic construct
DKVEKNRILQLSHDNIDNIAYIFSVYKNDDKIREALEGTDLDSKDIDVLIENLGTFSKFGHLSLKACYKILPYLEQGMVYSDACTAAGYDFRKSAQGSIADIPNPVVKRAISQTMKVLKAIKQKYGCPPVEIHIEMARELAKSFDERQKMTKSIEENQSHNERIKERLQKEFNVPYPSGQDIVKLKLYEEQNETCAYSQKHIDAAKLFHDPNYAEVDHIIPYSRSFDDTYNNKVLVLTAENRQKGNRTPMEYLSGDEARKKQFVAWVKSDIKKPRKRENLLREKFTADAENDWKARHLQDTQYISRFMLNYLQNNYELTPGNTDRKRRIIPVNGAVTAYVRKRLGISKIRENGDLHHAVDAAVIAAVTQGVVNSVSKYSKRHELQYHVDEHGNCVDLVTGELMGDAFKENHKIKGFPEPWPQFRAELEARVSENAAEAIRILKLPTYSPDEEIKTPFVSRMVRHKTTGQAHEDTVRGKSNVADNVYVKKVALTELKLKDGEIEGYYNPSSDRLLYEALKKRLEQFGGKGKDAFKEPFHKPKSDGSPGPIVKKCKVLDKINLAVPVHDGKGITKNAGGSMVRVDVFKVKKSNGGHQYYLVPIYVSDTVKERLPNRAVMAHKEYDEWKIVDDKDFVFSLYSNDLLFIGGKEIKLNGTGGDTLHQGIMVQNVYLYYRGLNIAAGTISVEDHDSKYIQESLGVGRVPVLEKYEVSVLGDLIKAPYRPRETFKHKAQRSK

SEQ ID NO: 11611 - protein, 594 aa, synthetic construct
MEIHIELARELAKSAKERTELEKAMKDNQSRNEKIKTKLHELNVMQPTGLDIVKYKLYEQQQGDCAYSQKKFDVNRLLHDPTYAEVDHIIPYSRSFDDTYRNKVLVLTKENRDKGNRTPMEYFQDKPERKEAFINWVKRTISDGKKRNNLLRVNYSADAEKEWKDRHLQDTQYINRYLYNYLKRHIELKEGYTDRKRRIIPVNGAVTAYVRKRLGISKIRETGDLHHAVDAVIIACVTQGVVNKISRYSKIKELRQFMTADGTVVDKETGEVLQTANPRKTDPFPEPWPKFRQELEARVSDNPAEAIAALGLPTYKGIVNISAPFVSRMPNRKVHGPAHMETIRSAKMQQDGYTMVKTELTNLKLKDGEIEGYYNPSSDKILYDALKRRLEQFGGDGNKAFKDPFYKPKSDGTPGPEVKKVKIMTKSSLNVAVNQGKGVADNGSMVRIDVFGVEEKGKNAYYFVPIYVADTVKETLPNRAVTRGEPYNNWKIMKDEDFLFSLYPNDLIYIESLSPVSFHTVKGCTLVPKIERKEMLLYYRKAGISTASITVLNHDNTYVKESLGIKTIGKLQKCTVDILGNVHYVQKEKRVGFK

SEQ ID NO: 11612 - protein, 1120 aa, synthetic construct
MNKSVKFGLGLDVGIASIGWATVALDEKGEPYKLLNLGSRIFDKAENPKDGSSLAMQRRQFRSQRRLIRRRRHRLDRVIFLFQKIGLCTNDELNKLFQTPAPKNVYELRVDALDRKLDKQEWIRVLYSVLKHRGFKSNRKNAKSEDGLLLKAIQSNEEIIFNNGYRTVGEMLFKDPLFTNSKRNKGGSYKNCVSRISIQKELDLLFEKQREYGNEFTSDYFKESFLNIFLAQRNFDEGPGAPSCYGGNLIEKMIGYCALKKDKKRAPKASLSFALFSFWSKINNIRYYDSNRCKEYSISTEQARKVLQKALIKSDLNYSDIRKIIGLDDGCYFKDITYTSKKSKKTKKKQQAKNNNESYLSIDGLTLVEDVLTPEKDANEQSVDTILDIEKKSKIKFFNSFISIKKAANGMLDHLNPFDPEDRKIFNRISYAFTVSKNDDGIAGYLNEIDISAEIKESLINNLDGFSQFGHISEEACEKLLPFLENGCDYTSACVEAGYVSSSDDVVGKDLLPARSSELDDIVNPVVRRSVSQLIKVVNSIIRENGKPEYINVEFARDLARSFADRREITKEQEDRKAHNEKVRKIIEETFGRARASSKDILIYKLWMEQESKCIYSGKHIDAHRLFEPGYVEVDHILPFSKSFDDSMTNKVLVFKEENQNKANRTPLEYMRASKPMYVDSYLAMVKFLYKSNFKKLQNLTTEFCGNDREEWSTSNLNDTRYIAKFIHKYIKDHLYPAKTGIKRVRAVNGRITSLLRHFWGIKKIRENGDLHHAVDAAVISVTTDMIIKKFSEASKRHEEYDEKIMVEKPWEMFVDEISARISENPADQVERLGLSTYSDEEKSSLKTPFVSRMPRHKVTGSVHDSTLRSPVLLKQGINAYVSKREINDKLLKVFDDKKCEFFNMQLDAKFYASLKSYLEDKNENKGEFHKIKKDGSLGPVVRKVKVVENCSSGVFLNNGKAFAKNGDMIRIDVFQVKEGKDKGFYFVPIYVADKVKDKLPSRAVIQGKDPKDWKEMKDEDFIYSLYPNDLIYFSSKKIVGFKNNNKSSEILGVDMSEGYLYYTGADISTASINVDFVDNSFSKHGLGVKTLKEFRKFTIDVLGNIHEVKKEKRLVFGRK

SEQ ID NO: 11613 - protein, 1078 aa, synthetic construct; identical to SEQ ID NO: 7620

SEQ ID NO: 11614 - protein, 560 aa, synthetic construct
GMDIMKLKLYEEQKGICLYSQKVMDIERVVKDGKYAEVDHILPYSRSFDDSMANKVLVLTSENQHKRNRTPMEYLQDDPVRLHRFVENAKSVVHNPRKLANLLKENFNPQVMKEWKERNLTDAKYISRFIYNFLNDHLLLADGKRKKRILAVNGVITAYIRKRLGINKIREDGDLHHAVDAVVIASITQGVIARATKYSQWQEVFRHNSSPDKQIIDYETGEILTGDSFKEFVDSRFPEPWPMFRKELEARAGKNPRYELEHLNLSTYSPEEIENIKPAFVSRMPTRKVTGSVHDETIRSPKLRDEGFSIVKTDLTKLKLTKDGSAIADYYKPESDKLLYEALLNRLQKYDGKADKAFAGDFYKPKADGTMGPLVKKVKTMSASTLNVGVNGGKGIANNGGMVRVDVFYIPEGKEKGYYLVPIYIADVKKEKLPSKAIVAQKSYNQWKEMDDCYFMFSLYPNDLIYIEKNDDIKLSLVKQYEGKSSLQKNIVDKHHGYYYYRKTGINTASISIIDADNVYTIPSLGVKGLKLLRKCEVDIFGNITLVGKEKRTDFSAMRK

SEQ ID NO: 11615 - protein, 865 aa, synthetic construct
MEKDKKRAPKASLSFALFSFWCKINNIRYYDLNKRKECSVSPDEAQKVLQKALIKSDLNYSDIRKILGLDENCYFKDIQYFSKKSRKTKKKAQIKNKSDLVIDGLMQVEDTSTTSKDANEQAADNIYDIEKNSKIKFFNHFISIKKAAKGMLDNLNPLDPNDRKIFNRISYAFTVSKNDAGIADYLNEIDISSDIKESLINNLDGFSQFGHISEDACEKLVPFLEHGMDYTSACIEAGYISSSDDVVGKDLLPARSPELDDIVNPVVRRSVSQLIKVVNSIIRESGKPEYINVEFARDLARSFADRREITKEQEERKALNEKVRKIIEETFGKSRVSSKDVLIYKLWMEQESKCIYSGKHIDANRLFETGYVEVDHILPFSKSFDDSMTNKVLVLKEENQNKGNRTPLEYMRALKPEYVNTYLAMVRLLYKSNFKKLQNLTTEFCGKDRDEWSSSNLNDTRYIAKFIHQYIKEHLYPAKTGTKRVRAVNGKITSLLRHYWGIKKIRENGDLHHAVDAVVISVTTDKMIKGFSEASKRHEEYDETMAVEKPWEKFVDEISARISENPAEQIESLGLTSYTDEEKAQLKTPFVSRMPRHKVTGSVHDSTLRSPVLLNQGINAYVSKKQVNDKLLKVFDDKKCEFFNIESDAKFYASLKSYLEDKNENKGEFHKIKKDGSIGPVVRSVKVVENCSSGVFLNNRKAFAKNGDMIRIDVFHVKEGKDKGFYFVPIYVADKVKNILPNKAVVAGKNVDEWKEMKEDDFIYSLYSNDLIYFSSKKFTSFKNNNKSAKIVAVDMCEGFLYYTSADISTASINVDFVDNSFSKHGLGLKTLKEFRKFTIDVLGNIHEVKKEKRLGFRKKERNVS

SEQ ID NO: 11616 - protein, 1106 aa, synthetic construct
MRYVLGLDIGIASVGWAVLELDSFDEPFKIIDLNSRIFTKAENPQDGSSLAKPRREARGNRRRLRRRRHRLDRIKHLIYVVGLMSKEGYDKLYTSGFDKDVYTLRAEGLDRSLSAAEWTRVLIHIAKHRGFKSNRKSTTVAGEDGKVLQAVKENQEILSKYRTVGEMFHNDDKFKSRKRNTTDSYILCVSRHMLKDEIKALFTAQRSFNNPFTDEKFEAKYIEIFESQRAFDEGPGSESPYGGNQIEKMIGQCTFEDGEKRAPKASYSFMRFNLLQKVNHIRIKSSSATRALSEEERSIIIALAYKSPNFTYGSIRKAIKLPYDMTFSDVYYKYEKGLSEEELIDKNEKSNKIKSLEPYHTIRKALDKVYKNRIEELSEDNINDIAYAFSVYKTNAKISQKLKECGIDNKDIEALINNLGTFAKFGHLSVKACKKINKYLETGMTYDKACEAAGYDFKGHCGEKTKFLSGAADEIKEIPNPVVKRALSQTIKVINAVVRKYGSPVEVHVELAREMARSKKDRDKINSIMKDNQAANDRIRGILKNEFNINNPTGIDILKYRLYQEQQGICVYSQKVMDLERVMKDGKYAEIDHILPYSRSFDDSYNNKVLVKTEENRLKRNRTPYEYMQDNEVKYKGFCEIVKSIIHNPTKVSNLLRENYNPQLVKDWKARNINDTRYISKFVYNFLNDHLLLADGMRKRRIIAVNGAVTGYIRKRLGINKIRANGDTHHAVDAVVIACVTQGVISKVTKYSQWQEVFYKNNNTGKLVDYETGEIITKDNFDEFIDSKFPEPWPLFRKELEARAGTNPKYEIECLRLDTYSPEEVTSLRPMFVSRMPNRKVTGQAHQETIRSSRMANDGMTVSKVPLTSLKLSKDGQSIEGYFSPESDRLLYEALLNRLQGFGGKADKAFTEPFYKPKNDGSKGPIVKAVKITAPSTLNVRINNGKGLADNGSMVRIDVFHITAGKGAGYYLVPIYVADTKKDKLPSKAIVAHKKYDEWKLMDEKDFVFSLYPNDLIYVEKKGNIELSLDKKIEKDSTLPKKISSPQGYFYYVKAGIGDGSVQIKSHDGVYLLPSMGVKTLKLLRKCVVDELGNISFVGKEKRQHF

SEQ ID NO: 11617 - protein, 1014 aa, synthetic construct
MRILGLDLGIASCGWALIDQAKDGEEGRILALGVRCFDAPEDSKDRTPNNQARRQHRGLRRVLRRRRQRMQELRHLFLAHGLLASAGPDALALPGIDPWAMRAEALDRALAPCELAVALGHIARHRGFRSNRNQRSNEAEDRTMLAAIAARQERTGHYRTIGEAFARDPEFARRKRNRDGDYGRSILREEHEREVRLIFARQRALGSQCATEALEQAFTDIAFFQRPLAASEDRVGPCPFEPGERRSARFAPSFELFRFLARLTTLRIGTRREERALTAEEIARAEQGFGTQQGMTFKRLRKLLNLAEAEGFIGISPEDEGRDVVNRSPGNGCMRGSAALRQAIGEGAWLRLLSTPERLDAIAFVLSFAAAKEFPERLAALGIEEDVIAAVLAGVEQGMFDHFAGAGHISAKACRKIIPGLRRGLVYSEACQEAGYDHARRPETSLSDVANPVARKAIGETLKQVRAIVAEYGLPERIHIELARDVGKSAEERAEIARGIEKRNRERDRLRRIFVETVGREPAGSEDMLRFELWLEQAGRCLYTDHCIPPDAIVAADNRVQVDHILPWSRFGDDSFANKTLCFATANQEKRGRTPFEWLGADQERWNRFVAVVEGCKGMKGRKKRIYLLKDAVSSEEKFRTRNLNDTRYAARIVLEHLAHFYPEDGSRRVFARPGALTDRLRRGWGLQDLKKKLEPDGEKRHEDDRHHALDALIVAATSESALQRLTRAFQEAETRGSHRDFSALTSPWPGFVDQAQEAFKTILVSRAERGRARGEAHEATIRQVRKDEDGPVVYERKSVEALTEKDLARVKDPERNAALIESLRAWIAAGKPKASPPLSPKGDPIAKVRLRTDKKPAIEVRGGVAERGEMVRVDVFRARNRHGRWEFYLVPIYPHQVADKVRWPTPPDRAVQGNTPEEQWPVMDAGYEFLFSLHQRSFIEVEKRDRTVITGYFMGLDRHTGSIAISTPHSTKALARGIGARTLMRFEKFRVDRLGRTFAVRQETRTWHGVPCT

SEQ ID NO: 11618 - protein, 1019 aa, synthetic construct
MAGRHLQDNLILGLDLGIGSCGWAVIDETRASDRIVAMGARTFDVPETDKKRTPTNQLRRQHRGLRTVIRRRRQRMNALRRLLSDAGLIADDRKGAIKIPGLDPWSLRADGLERKLTGPELAVALGHIAKHRGFKSNSKRDRGANAPKDSSEMLSAIDATRERMKSFRTIGEMFAKDPAYAIRKHNRDGDYTRSILRDDQEQEVRLLFDRQRAANNRLATEELERKFIDTAFFQRPLADSEDKVGDCPFELGETRAAKRCYSFELFRFLSRLTAQRIQSSSGERPLTALEIDAASKDFGAFRGMTFKRMRKLTALSDDYRFAGVPFEEEGKRDVVTRAGDLAAGTYALRKVLGSAWQTLLAIPDKLDGIAFVLSFREDVKSIQTGLDDLRIEPVIRDALMKGVRDGDFGDFKGAGHISAKACRNIIPHLKQGLVYSAACEASRYDHAKRPETDPAKIGNPIARKALTEAIKQVRAIVQEYGLPGRIHVELARDVGKSKEERDKIRSGIERRNKQKDWLREQFVATVGKEARSGEDMLRFELWREQNGRCLYTDREIHPNAIVASDNSVQVDHILPWSRSGDDSFVNKTLCFASANQEKKGRTPFEWFGKDEQRWAHFVAGVETNKSMKGRKKRNYVLRDASLLEEKFRPRNLNDTRYACRLLADALARMYSENSRRRIFARPGPLTDRLRRGWGIQDLKKDAEGNRVDDDRHHALDALVVAATTEGALQKLTRAFQEAEKIGAHRDFARLDPPWPEFVVEARAKLLNVFVSRAERRRARGEGHGATIRQIIGTDGNQIVYERKSVEELTEKDLARIKNPERNAKLIEALREWIAAGKPKDRKPLSPKGDPVAKIRLQTNKKADVLIRDGAAERGEMVRVDVFRKQNKKGAWEYYVVPIYPHQVANFVEWPTPPMRAVQAGKPEEGWPEISTTYEFCWSLYPLNFIELVKPDGEVIEGYLRGLSRSTGAFTISPHHTKEETRVGIGARTLSSIRKFSIDRLGGRFEIPRETRTWHGVVCT

SEQ ID NO: 11619 - protein, 1041 aa, synthetic construct
MEIREDVSLGIDLGIGSCGWAVIRQSGNNGEIIALGVRTFDVPETDEKRTPTNQLRRQFRGMRRVLRRRRQRMNAIRGLFAKTGLIDEPGPDALAVGLDPWQLRADGLERALSPIELAVALGHIARHRGFRSNSKRDRGANASKDSSAMLEAIDATRDRLGRWRTVGEMFARDPYYAGRKRNRDGDYARSVLREDQEHEVRRILARQRQLGAFSDNAFEARFLDLAFSQRPLADSEDTVGACPFEPEEKRAAKRARSFELFRFLARLTALRVGGRPLTAEELTAAAAEFGGQRGMTFKRLRKTIGLDPGERFDGLPPDDEGRRDVVNRSSSNGCMQGTAVLRAALGDTAWRSLLMAPEKLDRIAFVLTFREDLGSIRAGLEDVGLDPVVLDSLMTAAVQGDFADFRGAGHVSARVCRAVIPHLLQGKTYDKAMRAAGYRHTDRERPILAGLSFHDSVKAQVAWAADRIANPVARKALTEALKQAAAIIHEYGLPGRIHVEVARDVGKSKDMRDEISRGIERRNRQKDRLREEYCETVGRQPAGADDLLRFELWKEQNGRCLYTDQPISPAALVASDNSVQVDHILPWSRSGDDSYLNKALCIASANQEKKGRTPFEWLGPDEARWAAFAAGVESNRALKGLKKRNYLLRDASVLETKFRPRNLNDTRYACRLLADALAAFYPADDTIEEPQGPHRNRRRVFTRPGALTDRLRRGWGLQRVKKDDAGKRIADDRHHALDALIVAATSESALQRFTRLFQDAEAKGSHRDFSRLDPPWPGFIQEAREKLAAVFVSRAERRRARGAAHAATVRQISDRDGVPVVYERKAIANLSDRDLDRIKDADRNARLVGSLRAWIAAGSPKDAPPLSPKGDPIRKVRVATGKKPDVLVRAGAADRGVMVRVDVFRKQTADGSQGFFLVPIYPHQVGDPAGWPAPPDRAVAGGRDEADWPVIDSTYAFLFAVYPLSFLELVKPDGEIVEGYFRSLDRSTGAMTISPDWTKAQIRKGIGTRTLASLRKFTVDRLGRRYEVRRETRTWRGAACI

SEQ ID NO: 11620 - protein, 1016 aa, synthetic construct
MRILGLDLGIASCGWALIDQAEEGEEGRVLALGVRCFDAPEDSKDRTPNNQLRRQHRGLRRVLRRRRQRMRDVRLLFLAHGLLASARADALALPGLDPWALRAEALERALAPQELAVALGHIAKHRGFRSNRKRLANEAKDSKKMLAAIATRQERTGRFRTIGEAFARDPEFARRKRNRDGDYTRSILRSEQEHEVRVIFERQRALGSRFATEDLQDAFAGIAFFQRELAGSEERVGFCPFEPEERRAAKRSYSFELFRFLARLTALRVGTRREERALSAEEIARAAEGFGAQQGMTFARLRQRIGLPDGVGFAGIPPEEERKRDVVNRSAGNGCMRGSAALRQAIGEAAWLRLLTTPETLDAIAFVLSFAAAEEFPRRLAALGLGEEVVAAVLAGVEQGMFDHFSGAGHISAKACRAIIPGLRRGLVYSDACREAGYDHARRPATSLADIANPVARKAIGEALKQVRAIVAEHGLPDRIHVELARNVGKSAEERQEIERGIEKRNRERDRLRQVFVETVGREPAGAEDMLRFELWTEQAGRCLYTDQCIPPDAIVAADNRVQVDHILPWSRFGDDSFVNKTLCFASANQEKRRRTPFEWLGADPARWERFVAAVEACKGMKGRKKRIYLLKDAASVEEKFRARNLNDTRYAARIVLEHLARLYPEDGSRRVFARPGALTDRLRRGWGLQDLKKTLEPDSEKRREDARHHALDALIVAATSESALQRLTRAFQEAEARGSHRDFAALAPPWPGFVDQAREAFRAILVSRAERGRARGKAHDAMIRQVREEEGGPVVYERKAVEALTEKDLARVKDPERNAALIASLRAWIAAGKPKTTPPLSPKGDPIAKVRLATNKNVDVAVRGGAAERGDMVRVDVFRARNKRGAWEFYLVPIYPHQVADRERWPAPPDRAVQGNTPEEQWPVMDSGYEFLFSLHQRSFIEVEKRDGTVITGYFMGLSRNTGAINISVPHSTKDVVESIGARTLRRFEKFRVDRLGRVFAVGRETRTWHGVPCT

SEQ ID NO: 11621 - protein, 1021 aa, synthetic construct
MDWGETVKSLGIDLGIASCGWALIETDVAQGQIIACGARTFDAPETDKERTPTNQLRRQFRGMRRVMRRRRQRMAQLRMLFQENGLLTDAKRDALRFPGLDPWQLRVAALDRRLTPEELAVTLGHIARHRGFRSNKKNQGNEAGDDGRVLKAAAANQEILSKYRSVAEMFDKDDRFARRKRNRDGEYTQSVNRIDLEHEARLIFSRQRALGSAHADVHLQEKFAELAFNQNPLADSEDKVGFCPFEKKERRAAKRAYSFEVFRFLSRLNALRIGDARQERALTEAELAAAMEGFGSQRGMTFARLRKLIGLPDSEAFRDVPRDEEGGRDVVNRSAGNGCMQGSATLRAAIGEHNWKTLLQRPEKLDEIAFIITFRATPESIEKGLFEAGHDPDMTHAIMAAVEKGAFASFTGAGHVSAKACRAIIPGLQRGLVYSAACKATGFDPTARPVTEISSINNPVAKRAVFEALKQVKAIIAKHGKPDRIHIEMARDVGKSKEERDKITSGIEKRNKERNTLRAAFNDTVGGEPSGPEDMLRFELWTEQKGRCLYTDQAIPPSAIRAKDNSVQVDHILPWSRFGDDIFINKTLCFAKANQEKKGRTPFEWLKDDPERWAKFVACVETNKGMKGRKKRNYLLRDASAAEEKFRSRNLNDTRYACRILMEHLAREYFEGTKHMVVGRPGALTDKLRRAWGLQDLKKVLEPDGEKRKHDDRHHALDAIIVAAITDSAVQRLTQAFKESEDRGSHRDFADFPPPWPGFIEDVRRHFREILVSRAERGRARGEAHAATISQLKQTDDGPVIYERKAVDKLTLKDLERVKDPDRNAALIAALRAWIEAGKPKSTPPLSPKGDPIRKVRLITTDKPAVAVRGGNAERGEMVRVDVFRKANKRGVFEFFLVPIYPHQVADEKEWPAPPNRAARAAPTEDQWSEITAAHEFIFSIGPRTFLEVEKRDGTIIDGYFMGMDRATASIAISAHHSTKNVKKSIGVLGLKRFEKFRIDRLGNRHAVPQETRTWHGAVCT

SEQ ID NO: 11622 - protein, 1021 aa, synthetic construct
MDWGKTLKSLGIDLGIASCGWALIETDVAQGQIIACGARTFDAPETDKERTPTNQLRRQFRGMRRVMRRRRQRMAQLRMLFQENGLLTDAKRDALRFPGLDPWQLRVAALDRRLTPEELAVTLGHIARHRGFRSNKKNQGNEAGDDGRVLKAAAANQEILSKYRSVAEMFDKDDRFARRKRNRDGEYTQSVNRIDLEHEARLIFSRQRALGSAHADVHLQEKFAELAFNQNPLADSEDKVGFCPFEKKERRAAKRAYSFEVFRFLSRLNALRIGDARQERALTEAELAAAMEGFGSQRGMTFARLRKLIGLPDSEAFRDVPRDEEGGRDVVNRSAGNGCMQGSATLRAAIGEHNWKTLLQRPEKLDEIAFIITFRATPESIEKGLFEAGHDPDMTHAIMAAVEKGAFASFTGAGHVSAKACRAIIPGLQRGLVYSAACKATGFDPTARPVTEISSINNPVAKRAVFEALKQVKAIIAKHGKPDRIHIEMARDVGKSKEERDKITSGIEKRNKERNTLRAAFNDTVGGEPSGPEDMLRFELWTEQKGRCLYTDQAIPPSAIRAKDNSVQVDHILPWSRFGDDIFINKTLCFAKANQEKKGRTPFEWLKDDPERWAKFVACVETNKGMKGRKKRNYLLRDASAAEEKFRSRNLNDTRYACRILMEHLAREYFEGTKHMVVGRPGALTDKLRRAWGLQDLKKVLEPDGEKRKHDDRHHALDAIIVAAITDSAVQRLTQAFKESEDRGSHRDFADFPPPWPGFIEDVRRHFREILVSRAERGRARGEAHAATISQLKQTDDGPVIYERKAVDKLTLKDLERVKDPDRNAALIAALRAWIEAGKPKSTPPLSPKGDPIRKVRLITTDKPAVAVRGGNAERGEMVRVDVFRKANKRGVFEFFLVPIYPHQVADEKEWPAPPNRAARAAPTEDQWSEITAAHEFIFSIGPRTFLEVEKRDGTIIDGYFMGMDRATASIAISAHHSTKNVKKSIGVLGLKRFEKFRIDRLGNRHAVPQETRTWHGAVCT

SEQ ID NO: 11623 - protein, 1021 aa, synthetic construct
MDWGKTVKSLGIDLGIASCGWALIETDVAQGQIIACGARTFDAPETDKERTPTNQLRRQFRGMRRVMRRRRQRMAQLRMLFQENGLLTDAKRDALRFPGLDPWQLRVAALDRRLTPDELAVTLGHIARHRGFRSNKKNQGNEAGDDGRVLKAAAANQEILSKYRSVAEMFDKDDRFARRKRNRDGEYTQSVNRIDLEHEARLIFSRQRALGSAHADAHLQEKFAELAFNQNPLADSEDKVGFCPFEKKERRAAKRAYSFEVFRFLSRLNALRIGDARQERALTEAELAAAMEGFGSQRGMTFARLRKLIGLPEGEAFRDVPRDEEGGRDVVNRSAGNGCMQGSSILRAALGEHNWKTLLQRPEKLDEIAFIITFRATPESIEKGLFEAGLDPDMLHAIMAAVEKGAFASFTGAGHVSARACRAIIPGLQRGLVYSEACAAAGYDPTARPVTEISSINNPVAKRAIFEALKQVKAIIAKHGKPDRIHIEMARDVGKSKEERDKITSGIEKRNKERNTLRAAFNDTVGGEPSGPEDMLRFELWTEQKGRCLYTDQAIPPGAIRAKDNSVQVDHILPWSRFGDDSFINKTLCFAKANQEKKGRTPFEWLKDDPERWAKFVACVETNKGMKGRKKRNYLLRDASAAEEKFRSRNLNDTRYACRILMEHLAREYFEGTKHMVVGRPGALTDKLRRAWGLQDLKKVLEPDGEKRKHDDRHHALDAIIVAAITDSAVQRLTQAFKESEDRGSHRDFADFPPPWPGFIEDVRRHFREILVSRAERGRARGEAHAATISQLKQTDDGPLIYERKAVDKLTLKDLERVKDPDRNAALIAALRAWIEGGKPKSTPPLSPKGDPIRKIRLITTDKPAVAVRGGNAERGEMVRVDVFRKANKRGVFEYFLVPIYPHQVADEKAWPTPPNRAARAAPTEDQWSEITAAHEFIFSIGPRTFLEVEKRDGTIIDGYFMGMDRATASIAISAHHSTKNVKKSIGVLGLKRFEKFRIDRLGNRHAVPQETRTWHGAVCT

SEQ ID NO: 11624 - protein, 1080 aa, synthetic construct
MVGANIREGLILGIDLGIGSCGWALINDAADDDRIVALGVRTFDVPETGKKRTPTNQLRRQHRGLRTVLRRRRQRMNDIRSLFKNAGLLEGDGKTALKIGTLDPWRLRAEGLDRKLTGPELAVALGHIAKHRGFKSNSKRDRGANAPKESSEMFKAIAETVKRMKNYHTVGEMFAKDPEYAIRRRNRDGEYTRSILRDDQEREVRFLFDRQRAAGNRLATEELEQAFIAKAFTQGALADSWDKVGRCPFEPDQPRAAKHSQSFELFRFLSRLTALRLQSAGGDRELTPEEIKSASTNFGGKSGSMTFKRLRETLHLDGNVRFDGIPLDEEGSRDVVNRGSGNGCMKGTKALRDALGDAGWNAFRDKPEILDNIAFTLAFREDLASIRTGLAELGLEPLILDALMAGVEHGDFSSFKGAAHISAKACRAVIPYLLRGLVYDKAMAQAGYRHTDREGPLLEGETLHANIKRQIEWASERITNPIAKKALIEALKQVGAIVGEYGLPERIRVELAREVGKSKEERDEIRFGIDKRNKERDRLLKLFREEVGAEPQGQDMLRFELWKEQKCRCLYCDQSISPNSVVSSDNAVQIDHILPWSRSGDDSFVNKTLCHAKCNQEKKGQTPFEWFGKDEARWAAFSAGIENVKGMKGRKKRNYLLKDAKVLEEKFKPRNLSDTKYATRLLLDALASWYPDDVRAVSAKASEKANVHWFDAENSPRAKVRVSARPGPLTNRLRIGWGVQDLKKTMEPDGEKRKSDDRHHALDALIVAATSPSMLQQLTMASQKEERRGGHRDFSALQLPWPNFIKELRAKFDKIFVSRAERRRARGEAHAAMLHQIVEVNGEQLVYERKSVDALSEKDLQRIKDPHRNVQLIESLRVWIAAGKPKGQRPRSPKGDEIRKVRLESDSRPGVLVRRGLGGDKCGVADRSSIVRVDVFENTDEKSRSRYQFVPVYAHQIVEDHPPDRVFKLKTDYDKWSTISPNAPFLFSLYPMCFIEVSWKERGEKLPTHIEGYFRGIDVNDGRIALSDHRSKDSNAKELQWRLSPTTLMEMKKIQVDRLGRRFDIRSEKRSWRTRQSAAS

SEQ ID NO: 11625 - protein, 1020 aa, synthetic construct
MTLTLGLDIGTNSIGHALVETDEQGNVISLKHIGVRIFSDSRTDKEKKPLNEARRTARQARRQRERKKSRMKAVLRVLREHGLDPQDSLLESPYAARAAALTGPLSRSQVGRAIWHIAKHRGPRLVRKDDKEQGVIKEGIRSLETEMLAQKARTYGELLERIRLNGGSVRLRANSEGSYNRYPSRQVMEAEFNHLWESQVPHHPEVMTEALRERLITAIFYQRPLKPVYPGRCTLEPDEYRMPKAMPMAHEFRIRSEVANLTLKQGDEVRTLTANERQIVVDGLLNSEKLTFTAIAKLLGFRAGVKFNLEGDDGDGGKARNYLIGDLTSSKIRSVWPNFSKMPENMRLSLILALLDIDDELELKCKLRSDFGISPEVVDQLSSLMLPAGYINLSQKAVRAVLPYLQQGMGYAQACAAAGYHHSDHRPEELTPILPFYNELPGMKRYLGQEQKGKPGRISNPTVHVALNQVRKVYNTLVEVFGVPDCVNIEVTRELKQTAKQKIAANKQNAANKKVRDAFKEKFPERANSDQDLVRWRLWNELPEERKVCVYSGKEITLNDLFSPRVEIDHIIPHSISFDNSPSNLVLCAQGANRLKTNKTPHEAFAPGLHKEFNWSAIEQRVFELAADKCGTWAKKKLRFKPDYLDVGGDFATRQLNDTAYLSKVVRIYLGHSCPKVLAVRGAVTAICRKEWGLDRLLRDTVSDHADLFCLSSVKSTGVFMAPHHVTGGSHDIREDCSVNKLLKFGAEVVRVDPIGRFQTPGEIRRIEPRGPKVNFQNLRTTTRKPLTSLTANSISQIKDDGLRTKITAHIKEVNPKLLTDTLNREAKVELSRLLGEFGQKHSVGRVRIVANKSGVIVRHGAANQHTKVLIADTNHHGDVVVRDGKVKMLLTTYAELNHPPEVEAGWTLKMRLHKGDMIRVPGYVYNKYPKKPNYGKDRSDHRHHAVDAFVIACITPSLLRKISRSIALSKYNQLHEFPEPYERFKQELKTHLRKLVVSNKLDHSISAPIFTETNYGFTA

SEQ ID NO: 11626 - protein, 1080 aa, synthetic construct
MKGNFIMTINNVDKNINSFTRIALDIGTTSIGWALLKTDEKGEPLGIIDNGVRIFSSGRDDKTESPLNQKRQEVRTARRNRDRTTQRQKLIINTMIKIGLMPENKDERKKLELESPYELRNNALNEILPPYHIGRALFHLSQRRGFQSNRKSEDGNEGGAIKIAIAKTKQLLKENNSKTIGQYLYKRYKNNENTRIRNISDKNNKFEYDFYLHRSMLQDEFDRIWHKQAEQNNELFNDENYNRLKNVIFYQRDLKSKKEHIGYCTLFYTDKKLRCARAMPSFQRFRIAEQLIKLEYIQNGRGKKLVELSPELFKKFFDELASGKSLSFKQMKKQMLKAGVINDDRESFNLESETFKEININETANKLAVKKKKDNNNQPILPEFNNWDLQKQNNFIEILLSENDDEFVKTKLTNDFKLTDDIAQKCIDTQFASGYGNLCIDACEKITDFIIEQGLRYDQAVKEDEKEDEKEDKKEDKLPYYAKCLQEHCTGGHGDENTQENYENPYIKDVKVYGRIANPTVHVGLVQLQYVINDIISIHGKPNFATVEFANELKNNQKQKDIYKKNQKKNQAKNEIFKKEIEDLGEQINRDNMLRMRLWYELDENNINNRRCIYTGKQISSRMVLSSEVEIEHILPFSRTLDDSSANKTLSMRTANRYKSNRSPYDAFSESNDGCYDWDEIYTRAQKLPKNKKMRFNKDAMEKYKDSGSIKDRQLNDTRYLTKVAKKYLALIIPESERNINVIPGRLTAMLRGKWGLNHILQHENYGSSNKNRDDHRHHAIDAIVVGCTTRGMLQRVASKIGKNFERNDKLLADIATPWDNIINDVKKSIDKIIVSYKSDRYKQGRLHEESFYGKEADCFDKKGNKIENIIVASIRRPLSDFETSKKVDEIKDEKIKSEIKQDIAYIKGDIQKAVKNFASKKGIRRLKTIQVKENLIKIGDKKTKGYERYVIGGKNWCIDIYQKLNSDKWEGCVIQTHYANQNNFVPDWKKNNPTAKKIMRLHIKDLIITNDNKIMCLRKIDNSSAIHFYLHNESNVPKREKELRHKGNYLTGAVSKLQELDICKVDISPAGRIQKRIRK

SEQ ID NO: 11627 - protein, 1087 aa, synthetic construct
MYPYAIGFDIGITSVGWAVVALDGEDKPFGIINMGSRIFDAAEQSKTGASLAAPRREARSMRRRLRRHRHRLERIRHLLVAENVISQAELDALFEGKLEDIYTLRVKALDTAVSHADFARILLHIAQRRGFKSNRKSSTSKEDGELLAAVSANRALMAEKGYRTVGEMLLKDPQYSGSKRNKGGKYLATVGRDMVEEEVRAIFKAQREQGQAFAATELEEQYLEILLSQRSFDEGPGEGSPYRGSQIEKMIGKCTLEAGEPRAAKASYSFEYFTLLQNINHLRLICGGESRPLSDAQREFLIALAHKTKDLNFSRIRKELDIPADTTFNAVSYKSADGYEDAEKKAKFCYLKAYHQMKAAFNKLSKGHFDSLARQQKNELGRVLSTYKTSANIRPRLAAAGLSEMEIDIAETMSFSKFGHISVKACDKLIPFLEKGLKYNDACAAAGYDFKGYDSETRTRLLHPTEDDFADVTSPVVRRAISQTAKVLNAIIRERGNSPTFINIELAREMARDFTERSKMKKDMDENHARNERIMERIRTEYGKEHPTGQDLVKFKLWEEQHGECAYSQKHLSLKHLFDPDYAEVDHIIPYSISFDDGYKNKVLVLAEENRNKGNRLPLLYLQGERRADFIVWVENSIHDYRKKQRLLKETITAEDEKGFKERNLQDTKTMSRFLLNYISDHLEFSDFSTGRKKHVTAVNGAITSYLRKRWGIAKIRENGDLHHAVDALVVVCTTDGMIQQLSRYSTLRECEYVQTEAGSIAVSMHTGEVLKRFPYPWPEFRRELEARLGDDPRRAVISQRFPVYANGDIPVRKLFVSRMPRRKVTGAAHKETIKSPKALNDGIVVVKRALTDLKLDPKTGEISNYYMPQSDRLLYEALKEALKKHGGDAAKAFAAPFHKPKSDGTPGPVVNKVKLCEPTTLNVAVLNGAGVADNDSMVRIDVFRVENDGYYFVPIYIADTLKAELPNKACTRGKPYAEWREMDAEDFLFSLYPNDLIRVTSQKGLTLSKAQKESTLPDTYETKQEMLYYTSASINTAAVACRTHDNSYEIKSMGIKTLEKLEKFTVDVLGEYHKVEKEPRMAFCRK

SEQ ID NO: 11628 - protein, 1087 aa, synthetic construct
MLPYAIGLDIGITSVGWAALALDGNERPCGIIGMGSRIFTAAEQPKTGESLAAPRRAARSARRRLRRHRHRNERIRSLLVSSGVVTPSELDSLFDGQLEDIYALRTRALDEQLCGAELARILLHISQRRGFRSNRKGGVSKEDGLLLDAVNENVARMQKHGYRTVGEMFFRDEVFKDHKRNKGGEYITTVKREMVADEVRAIFSAQLSLGSTAASEELENRYLDILLGQRSFDEGPGGNSPYGGSQIERMVGRCTFFPDEPRAARATYSFEYFSLLEKVNHIRIIRGGEVSKLTDEQRSRTIELAHMAKDVSYAKLRKELGLSDNELFNIRYPNDSTVEQTEKKEKLGSMKAYHQMRTEIDRISKGRFAMMPREQRNAIGTALSLYKTSDKIRAYLESAGLDELDIAAADSIGSFSKFGHISVKACDMLIPFLERGMNYNEACAAAGIDFRAHNAGERAMYLHPTEDDYAEITIPVVRRAISQTVKVLNAIIRKQGGSPTFINIELAREMANDFSERNKLKRENDENRAKNERLLERIKTEYGKRNPTGLDLVKLRLYEEQGGVCMYSLRQLSLEKLFAPNYAEVDHIVPYSISFDDSRKNKVLVLTEENRNKGNRLPLQYLTGQRRDDFIVWVNNNVKDPRKRKLLLKENLTDAEAAGFKERNLQDTKTMSRFLLNYIADNLEFAESRCGRKKKVTAVNGVITSYMRKRWGITKIREDGDLHHAVDAVVIACTTDAMIQQVSRYARFRECEYMHTSSGSIAVDSGTGEVLRTFPYPWHDFRKELEARLANDPARVINDLRLPFYAESGLPLPEPVFVSRMPERKVTGAAHLDTVKSPRELKNGLLIIKKPLTELKLKNGEIDGYYDPDSDRLLYNALRQRLIECGADAKAAFADGFRKPKSDGTPGPVVKKVKICESATLGVPVHGGKGVAGNDSMVRVDVFLAGGKYLLVPIYVADTLKPELPNRAVAAHKPYSEWREVSDDDFIFSLYPNDLICATHKKGIKLSVCQKGSSLPPTVVEKSLMLYYKGTDISTGAITCITHDHSYEARGIGVMTLEKLEKYTVDVLGEYHKVKKEVRQPFNMKRS

SEQ ID NO: 11629 - protein, 1088 aa, synthetic construct
MLPYAIGLDIGITSVGWATVALDEDDRPFGIIGMGSRIFDAAEQPKTGESLAAPRREARSARRRLRRHRHRNERIRALLIREQVLSEEQLARLFEGQLPDIYALRVKALDEAVSGEELARILIHISQRRGFKSNRKGAASKEDGELLTAVSANKERMAAHGYRTVAELYLNDEAYREHRRNKGGKYISTVSRDMVEDEVHQIFAAQRKLGNPAATEALESSYVEILLSQRSFDDGPACGPYAGSQIERMIGKCPFEPEELRAGKATYSFELFSLLEAINHIRIVTNRRGVPLTPEQREALVQLAHKTADLNYAKIRKELALADEQTFNMVAYGKVDDEADAEKKTKFAHLKAYHQMRKAFEAVAKGHFADITREQRNAIGDVLSKYKTDAKIRPALQKAGLSDADIDVAESLNFSKFGHISAKACNKIIPYLEQGMTYSDACTAAGYQFKGHDGREKSHLLPPLDEDARNTITSPVALRAISQTIKVVNAIIRERGCSPTFINVELAREMSKDFYERNQIKKDQDENRARNERLMERIRTDYGKVSPTGLDLVKLKLYEEQGGVCAYSQKQMSLEHLFDADYAEVDHIIPYSISFDDGYKNKVLVLSKENRDKGNRLPLQYLTGKRREDFIVWVNSFVKDYRKRQRLLKESFTEEDEAKFKERNLQDTKTAARFVLNYIADHLEFAPFATERKKHVTSVNGSVTSYMRKRWGITKVRANGDLHHAVDALVIACTTDSMIQKVSQFARYRETRYTTGEDSRFVVDPDTGEVIKEFPYPWPRFRQELEARLGSDPRHAVRDQGFPLYLAEDIPIRPLFVSRMPRRKVTGAAHKETIKSGKALSDGLLIVKKPLTDLKLDKDGEIANYYNPSSDRLLYEALKARLQMFSGDGKKAFAEPFRKPKSDGTPGPVVNKVKLCETTTLNVSVHGGKGVADNDSMVRIDVFHVEGDGYYFVPIYVADTLKAELPSKACVAFKPHSEWKDMRNEDFIFSLYPNDLVKVTHKKALKLTKAQKDSDLPDSRAVQNELLYFVSAGINTASITCRNHDNSYKIDSLGIKTLESLEKYTVDVLGEYYPVKRETRQAFSRKKG

SEQ ID NO: 11630 - protein, 1087 aa, synthetic construct
MLPYAIGLDIGITSVGWTALALDGDERPCGIIGMGSRIFTAAEQPKTGESLAAPRRAARSARRRLRRHRHRNERIRSLLVSSGVVTPSELTSLFDGQLEDIYALRTRALDEQLGGAELARILLHISQRRGFRSNRKGGASKEDGLLLEAVNENAARMQKHGYRTVGEMFFRDEAFKDHKRNKGGEYITTVKREMVADEVRAIFSAQRDLGSTAASEELESRYLDILLGQRSFDEGPGGNSPYGGSQIERMVGRCTFFPDEPRAARATYSFEYFSLLEKVNHIRIVRGGEVSKLTDEQRSRAIELAHTAKDVSYAKLRKELGLSDNELFNIRYPNDSTIEQTEKKEKLGLMRAYHQMRTEIDRISKGRFAMMPREQRNAIATALSLYRTSDKIRAYLEAAGLDELDIAAADSIGSFSKFGHISVKACDMLIPFLERGMNYNDACAAAGIDLRAHNAGERAMYLHPTEDDYAEITSPVVRRAISQTVKVLNAIIRKQGGSPTFINIELAREMANDFSERNKLKHENDENRAKNERLLERIKTEYGKRDPTGLDLVKLRLYEEQGGVCMYSLRQLSLEKLFAPNYAEVDHIVPYSISFDDSRKNKVLVLTEENRNKGNRLPLQYLTGQRRDDFIVWVNNNVKDPRKRKLLLKENLTDAEAAGFKERNLQDTKTMSRFLLNYIADNLEFAESRCGRKKKVTAVNGVITSYMRKRWGITKIREDGDLHHAVDAVVIACTTDAMIQQVSRYARFRECEYMHTSSGSIAVDSGTGEVLRTFPYPWHDFRKELEARLANDPARVINDLRLPFYAGSGLPLPEPVFVSRMPERKATGAAHLDTVKSPRELKNGLLIVKKPLTELKLKNGEIDGYYDPDSDRLLYNALRQRLIECGADAKAAFADGFRKPKSDGTPGPVVKKVKICESATLGVPVHGGKGVAGNDSMVRVDVFLAGGKYLLVPIYVADTLKPELPNRAVAAHKPYSEWREVSDDDFIFSLYPNDLICATHKKGIKLSVCQKGSSLPPTVVEKSLMLYYKSTDISSGGITCITHDHSYEARGIGVMTLEKLEKYTVDVLGEYHKVKKEVRQPFNMKRS

SEQ ID NO: 11631 - protein, 1087 aa, synthetic construct
MLPYAIGLDIGITSVGWATVALDEEDRPFGIIGMGSRIFDAAEQPKTGDSLAAPRRAARSARRRLRRHRHRNERIRALLIREQVLSEEQLAHLFEGQLPDIYALRVKALDSLVSNEVLARILIHISQRRGFKSNRKDAASAEDGELLTAVAANKERMTAHGYRTVAELYLKDEAYRDHRRNKGGKYISTVSRDMVEDEVHQIFSAQRRLGNPAATEALEKSYTEILLSQRSFDDGPGCGPYAGSQIERMIGQCPFEPTEQRAAKATYSFELFSLLEAINHIRIVTNKESIPLTAERREKLIALAHKTADLNYAKIRKELSLTEDQRFNMVSYGKADAGEAEKKTKFVHLKAYHQMRAAFERAAKGHFADITREQRNAIGDTLTKYKTDAKVRPALRKAGLSEADIDIAESLNFSKAGHLSVKACDKIIPHLERGMNYSDACTAAGYQFKAHDDQAKTHLLPPLDEDARNTITSPVALRAISQTIKVVNAIIRERGCSPTFINVELAREMSKDFYERNQIKKDQDENRARNERLMERIRTEYGKASPTGLDLVKLKLYEEQGGVCAYSQKQMSLEHLFDADYAEVDHIIPYSISFDDGYKNKVLVLSKENRDKGNRLPLQYLTGKRREDFIVWVNSSRLDYRKRQRLLKESFTEEDEAKFKERNLQDTKTAARFVLNYITDHLEFAPFATERKKHVTAVNGSVTSYMRKRWGIAKVRANGDLHHAVDALVIACTTDGMIQKVSQFARYRETRYTTGEDSRFVVDPDTGEVIKEFPYPWARFRQELEARLGSNPRRAVRDQGFPLYLTEDVPVRPLFVSRAPRRKVTGAAHKETIKSGKAVKDGVLIVKKPLTELKLGKDGEIANYYDPKSDRLLYEALKARLRLFGGDGKKAFAEPFRKPKSDGTSGPIVNKVKVCEATTLNVSVHGGKGIADNDSMVRIDVFHVEGDGYYFVPIYVADTLKAKLPSKACVAFKPYAEWKEMRDEDFIFSLYPNDLMKVTHKKTLKLTKAQKDSDLEDIRTVQSELLYFVSAGISTASISCRNHDNSYKIDSLGIKTLESLGKYTVDVLGEYHPVKRETRQGFAERKK

SEQ ID NO: 11632 - protein, 1088 aa, synthetic construct
MLSYAIGLDIGITSVGWATVALDEEDKPYGIIGMGARIFDAAEQPKTGASLAAPRREARSARRRLRRHRHRNERVRELLLKKQVITQATLSRLFEGVLPDIYSLRVEALDRIVSNEEFARILIHIAQRRGFKSNRKSESSKEEGELLAAVKANKARMDQCGYRTPAEMYLKDPSYQDHRRNKGGQYVATVSRDMVEDEVHRIFDAQRKLGSRIADEDLENAYLEILLSQRSFDEGPGGNSPYAGNQIERMIGTCTFEPQEQRAAKATYSFEYFSLLQAVNQIRIVTEKDSIPLTREQREKLIALAHRTAKLDYARIRRELGLAEAQTFNTVAYGKLDPAEAEKKTPFAHLKAYHQMRTAFERVAKGHFADITAAQRNAIGETLSRYKTSAKIRPALEAAGLSDADIDVVETLNFSKFGHISTKACDKIIPYLEQGMKYNEACEAAGYRFKAHDGSAGNTYLPVLDEDAKTELTSPVVLRAVSQSIKVINAIIRERGYSPTFVNIELAREMSKDFQERVKIKKEQDENRARNDRMMERIRNEYGKTSPTGQDLVKLKLYEEQGGVCAYSLRQMSLEHLFDPDYAEVDHIVPYSISFDDSYKNKVLVLTKENRDKGNRLPLQFLTGKRRDDFIVWVNSCVRDYRKRQILLKERITEEDTKRFIERNLQDTKTASRFLLNYINDNLSFAPFASGRKKHVTAVNGSVTAYMRKRWGITKVRANGDLHHAVDALVIVCTTDGMIQEVSRYAKFRENRYTPEADGRFLVDSATGEVLKEFPQPWPRFRQELEARLGSDPRRAVRDQGFPLCLEEGIPLRPLFVSRAPRRKVTGAAHKETVKSGRALENGVLVVRKPLTDLKLDKDGEIANYYSPESDRLLYEALKQRLRLYGGDGKKAFAEPFRKPKSDGTPGPIVNKVKLCEKTTLNVPVHGGKGAADNDSMVRIDVFRVEGDGYYFVPVYVADTLKPTLPNRACVQGKSYSEWKEMKDEDFLFSLYPNDLVRVTHKKALKLTKAQKDSDLPDSYETKSELLYFVSAGIAVATLTCRNHDSSYKIDSLGIKTLESFEKYTVDVLGEYHPVKRESRQTFAGRRD
